US012622926B2

(12) United States Patent
Amigorena et al.

(10) Patent No.: US 12,622,926 B2
(45) Date of Patent: May 12, 2026

(54) IMMUNOTHERAPY TARGETING TUMOR NEOANTIGENIC PEPTIDES

(71) Applicants: INSTITUT CURIE, Paris (FR); MNEMO THERAPEUTICS, Paris (FR); INSTITUT NATIONAL DE LA SANTE ET DE LA RECHERCHE MEDICALE, Paris (FR)

(72) Inventors: Sebastian Amigorena, Paris (FR); Marianne Burbage, Paris (FR); Alexandre Houy, Vitry sur Seine (FR); Marc-Henri Stern, Paris (FR); Joshua Waterfall, Paris (FR); Benjamin Sadacca, Paris (FR); Antonela Merlotti Ippolito, Paris (FR); Yago Arribas De Sandoval, Paris (FR)

(73) Assignees: INSTITUT CURIE, Paris (FR); MNEMO THERAPEUTICS, Paris (FR); INSTITUT NATIONAL DE LA SANTE ET DE LA RECHERCHE MEDICALE, Paris (FR)

( * ) Notice: Subject to any disclaimer, the term of this patent is extended or adjusted under 35 U.S.C. 154(b) by 896 days.

(21) Appl. No.: 17/639,568

(22) PCT Filed: Sep. 2, 2020

(86) PCT No.: PCT/EP2020/074429
§ 371 (c)(1),
(2) Date: Apr. 20, 2023

(87) PCT Pub. No.: WO2021/043804
PCT Pub. Date: Mar. 11, 2021

(65) Prior Publication Data
US 2024/0082372 A1 Mar. 14, 2024

(30) Foreign Application Priority Data

| | | |
|---|---|---|
| Sep. 2, 2019 | (EP) | 19306064 |
| Dec. 20, 2019 | (EP) | 19218556 |
| Jul. 1, 2020 | (EP) | 20305743 |

(51) Int. Cl.
| | |
|---|---|
| *A61K 35/17* | (2025.01) |
| *A61K 40/11* | (2025.01) |
| *A61K 40/32* | (2025.01) |
| *A61K 40/42* | (2025.01) |
| *A61P 35/00* | (2006.01) |
| *C07K 14/74* | (2006.01) |
| *C07K 16/28* | (2006.01) |
| *C07K 16/30* | (2006.01) |
| *C12N 5/078* | (2010.01) |
| *A61K 39/00* | (2006.01) |

(52) U.S. Cl.
CPC .............. *A61K 35/17* (2013.01); *A61K 40/11* (2025.01); *A61K 40/32* (2025.01); *A61K 40/4201* (2025.01); *A61P 35/00* (2018.01);

*C07K 14/70539* (2013.01); *C07K 16/2833* (2013.01); *C07K 16/30* (2013.01); *C12N 5/0634* (2013.01); *A61K 2039/86* (2018.08); *C07K 2317/92* (2013.01)

(58) Field of Classification Search
CPC ........ A61K 35/17; A61K 40/11; A61K 40/32; A61K 40/4201; A61K 2039/86; A61P 35/00; C07K 14/70539; C07K 16/2833; C07K 16/30; C07K 2317/92; C07K 2317/32; C07K 14/4748; C07K 2319/03; C07K 14/7051; C12N 5/0634
See application file for complete search history.

(56) References Cited

U.S. PATENT DOCUMENTS

| | | |
|---|---|---|
| 4,235,871 A | 11/1980 | Papahadjopoulos et al. |
| 4,501,728 A | 2/1985 | Geho et al. |
| 4,722,848 A | 2/1988 | Paoletti et al. |

(Continued)

FOREIGN PATENT DOCUMENTS

| | | |
|---|---|---|
| EP | 2537416 A1 | 12/2012 |
| WO | WO-1991/06309 A1 | 5/1991 |

(Continued)

OTHER PUBLICATIONS

Lee et al. (Trends in Immunology, 39(7): 536-548).*

(Continued)

*Primary Examiner* — Nelson B Moseley, II
(74) *Attorney, Agent, or Firm* — RinLaures LLC; Li-Hsien RinLaures; Kristen A. Dola

(57) ABSTRACT

The present disclosure relates to a method for selecting a tumor neoantigenic peptide wherein said method comprises: —a step of identifying, among mRNA sequences from cancer cells of a subject, a fusion transcript sequence comprising a transposable element (TE) sequence and an exonic sequence, and including an open reading frame (ORF), and—a step of selecting a tumor neoantigenic peptide of at least 8 amino acids, encoded by a part of said ORF of the fusion transcript sequence, wherein said ORF overlaps the junction between the TE and the exonic sequence, is pure TE and/or is non-canonical, and wherein said tumor neoantigenic peptide binds to at least one Major Histocompatibility Complex (MHC) molecule of said subject. The present disclosure also relates to tumor neoantigenic peptide obtained according to the present method, vaccine or immunogenic composition, antibodies and immune cells derived thereof and their use in therapy of cancer.

6 Claims, 19 Drawing Sheets
Specification includes a Sequence Listing.

(56) References Cited

U.S. PATENT DOCUMENTS

| | | | |
|---|---|---|---|
| 4,837,028 | A | 6/1989 | Allen |
| 5,019,369 | A | 5/1991 | Presant et al. |
| 5,204,253 | A | 4/1993 | Sanford et al. |
| 5,279,833 | A | 1/1994 | Rose |
| 5,580,859 | A | 12/1996 | Felgner |
| 5,589,466 | A | 12/1996 | Felgner et al. |
| 6,410,319 | B1 | 6/2002 | Raubitschek et al. |
| 6,451,995 | B1 | 9/2002 | Cheung et al. |
| 7,070,995 | B2 | 7/2006 | Jensen |
| 7,265,209 | B2 | 9/2007 | Jensen |
| 7,354,762 | B2 | 4/2008 | Jensen |
| 7,446,179 | B2 | 11/2008 | Jensen et al. |
| 7,446,190 | B2 | 11/2008 | Sadelain et al. |
| 7,446,191 | B2 | 11/2008 | Jensen |
| 8,324,353 | B2 | 12/2012 | Jensen et al. |
| 8,339,645 | B2 | 12/2012 | Nakawaki et al. |
| 8,398,282 | B2 | 3/2013 | Kuhlman et al. |
| 8,479,118 | B2 | 7/2013 | Lyndersay et al. |
| 2002/0131960 | A1 | 9/2002 | Sadelain et al. |
| 2013/0149337 | A1 | 6/2013 | Cooper et al. |
| 2013/0287748 | A1 | 10/2013 | June et al. |
| 2014/0120622 | A1 | 5/2014 | Gregory et al. |
| 2019/0177383 | A1 | 6/2019 | Mahr et al. |
| 2019/0224236 | A1* | 7/2019 | Riddell .................. A61K 40/32 |

FOREIGN PATENT DOCUMENTS

| | | | |
|---|---|---|---|
| WO | WO-1993/24640 | A2 | 12/1993 |
| WO | WO-1996/18372 | A2 | 6/1996 |
| WO | WO-2000/14257 | A1 | 3/2000 |
| WO | WO-2012/129514 | A1 | 9/2012 |
| WO | WO-2013/071154 | A1 | 5/2013 |
| WO | WO-2013/123061 | A1 | 8/2013 |
| WO | WO-2013/126726 | A1 | 8/2013 |
| WO | WO-2013/166321 | A1 | 11/2013 |
| WO | WO-2014/031687 | A1 | 2/2014 |
| WO | WO-2014/055668 | A1 | 4/2014 |
| WO | WO-2016/172722 | A1 | 10/2016 |

OTHER PUBLICATIONS

An et al., NCG 5.0: updates of a manually curated repository of cancer genes and associated properties from cancer mutational screenings. *Nucl. Acids Res.*, 44(D1): 992-9 (2016).

Baeuerle et al., Bispecific T-cell engaging antibodies for cancer therapy. *Cancer Res.*, 69(12): 4941-4 (2009).

Boegel et al., HLA typing from RNA-Seq sequence reads. *Genome Med.*, 4(12): 102 (2012).

Boudousquie et al., Polyfunctional response by ImmTAC (IMCgpIOO) redirected CD8+ and CD4+ T cells. *Immunology*, 152(3): 425-38 (2017).

Bulik-Sullivan et al., Deep learning using tumor HLA peptide mass spectrometry datasets improves neoantigen identification. *Nat. Biotechnol.*, 37(1): 55-63 (2018).

Chiappinelli et al., Inhibiting DNA methylation causes an interferon response in cancer via dsRNA including endogenous retroviruses. *Cell*, 162(5): 974-86 (2015).

Chong et al., Integrated proteogenomic deep sequencing and analytics accurately identify non-canonical peptides in tumor immunopeptidomes. *Nat. Commun.*, 11(1): 1293 (2020).

Chothia et al., The outline structure of the T-cell alpha beta receptor. *EMBO J.*, 7(12): 3745-55 (1988).

Cohen et al., Recognition of fresh human tumor by human peripheral blood lymphocytes transduced with a bicistronic retroviral vector encoding a murine anti-p53 TCR. *J. Immunol.*, 175(9): 5799-808 (2005).

Davila et al., CD19 CAR-targeted T cells induce long-term remission and B Cell Aplasia in an immunocompetent mouse model of B cell acute lymphoblastic leukemia. *PLoS One*, 8(4): e61338 (2013).

Dobin et al., STAR: ultrafast universal RNA-seq aligner. *Bioinformatics*, 29(1): 15-21 (2013).

Felgner et al., Lipofection: a highly efficient, lipid-mediated DNA-transfection procedure. *Proc. Natl. Acad. Sci. U.S.A*, 84(21): 7413-17 (1987).

Graham et al., Allogeneic CAR-T cells: more than ease of access? *Cells*, 7(10): 155 (2018).

Hasan et al., Artificial antigen presenting cells: an off the shelf approach for generation of desirable T-cell populations for broad application of adoptive immunotherapy. *Adv. Genet. Eng.*, 4(3): 130 (2015).

Helman et al., Somatic retrotransposition in human cancer revealed by whole-genome and exome sequencing. *Genome Res.*, 24(7): 1053-63 (2014).

Javitt et al., Pro-inflammatory cytokines alter the immunopeptidome landscape by modulation of HLA-B expression. *Front Immunol.*, 10(141): 1-16 (2019).

Jores et al., Resolution of hypervariable regions in T-cell receptor beta chains by a modified Wu-Kabat index of amino acid diversity. *Proc. Natl. Acad. Sci U.S.A.*, 87(23): 9138-42 (1990).

Kim et al., The ABCs of artificial antigen presentation. *Nat. Biotechnol.*, 22(4): 403-10 (2004).

Kim et al., TopHat2: accurate alignment of transcriptomes in the presence of insertions, deletions and gene fusions. *Genome Biol.*, 14(4): R36 (2013).

Kim et al., HISAT: a fast spliced aligner with low memory requirements. *Nat. Methods*, 12(4): 357-60 (2015).

Kiyotani et al., Immunopharmacogenomics towards personalized cancer immunotherapy targeting neoantigens. *Cancer Sci.*, 109(3): 542-9 (2018).

Kong et al., Transposable element expression in tumors is associated with immune infiltration and increased antigenicity. *Nat. Commun.*, 10(1): 5228 (2019).

Langmead et al., Ultrafast and memory-efficient alignment of short DNA sequences to the human genome. *Genome Biol.*, 10: R25 (2009).

Laumont et al., Noncoding regions are the main source of targetable tumor-specific antigens. *Sci. Transl. Med.*, 10(470): 1-11 (2018).

Lefranc et al., IMGT unique numbering for immunoglobulin and T cell receptor variable domains and Ig superfamily V-like domains. *Dev. Comp. Immunol.*, 27(1): 55-77 (2003).

Li et al., Directed evolution of human T-cell receptors with picomolar affinities by phage display. *Nat. Biotechnol.*, 23(3): 349-54 (2005).

Lundegaard et al., NetMHC-3.0: accurate web accessible predictions of human, mouse and monkey MHC class I affinities for peptides of length 8-11. *Nucl. Acids Res.*, 36(Web Server issue): W509-12 (2008).

Neal et al., The basics of artificial antigen presenting cells in T cell-based cancer immunotherapies. *J. Immunol. Res. Ther.*, 2(1): 68-79 (2017).

Nielsen et al., NetMHCpan, a method for quantitative predictions of peptide binding to any HLA-A and -B locus protein of known sequence. *PLoS One*, 2(8): e796 (2007).

Parkhurst et al., Characterization of genetically modified T-cell receptors that recognize the CEA:691-699 peptide in the context of HLA-A2.1 on human colorectal cancer cells. *Clin. Cancer Res.*, 15(1): 169-80 (2009).

Pradeepkiran et al., CGMD: An integrated database of cancer genes and markers. *Sci. Rep.*, 5: 12035 (2015).

Rathe et al., Identification of candidate neoantigens produced by fusion transcripts in human osteosarcomas. *Sci. Rep.*, 9(1): 358 (2019).

Ren et al., Multiplex genome editing to generate universal CAR T cells resistant to PD1 inhibition. *Clin. Cancer Res.*, 23(9): 2255-66 (2017).

Sadelain et al., The basic principles of chimeric antigen receptor design. *Cancer Discov.*, 3(4): 388-98 (2013).

Schiavetti et al., A human endogenous retroviral sequence encoding an antigen recognized on melanoma by cytolytic T lymphocytes. *Cancer Res.*, 62(19): 5510-6 (2002).

Shen et al., Double agents: genes with both oncogenic and tumor-suppressor functions. *Oncogenesis*, 7(3): 25 (2018).

Stover et al., New use of BCG for recombinant vaccines. *Nature*, 351(6326): 456-60 (1991).

(56)          References Cited

OTHER PUBLICATIONS

Szoka et al., Comparative properties and methods of preparation of lipid vesicles (liposomes). *Annu. Rev. Biophys. Bioeng.*, 9: 467-508 (1980).

Takahashi et al., Regression of human kidney cancer following allogeneic stem cell transplantation is associated with recognition of an HERV-E antigen by T cells. *J. Clin. Invest.*, 118(3): 1099-109 (2008).

Torikai et al., Toward eliminating HLA class I expression to generate universal cells from allogeneic donors. *Blood*, 122(8): 1341-9 (2013).

Turtle et al., Engineered T cells for anti-cancer therapy. *Curr. Opin. Immunol.*, 24(5): 633-9 (2012).

Varela-Rohena et al., Control of HIV-1 immune escape by CD8 T cells expressing enhanced T-cell receptor. *Nat. Med.*, 14(12): 1390-5 (2008).

Verhoef et al., Des-enkephalin-γ-endorphin (DEγE): biotransformation in rat, dog and human plasma. *Eur. J. Drug. Metab. Pharmacokin*, 11(4): 291-302 (1986).

Walseng et al., Soluble T-cell receptors produced in human cells for targeted delivery. *PLoS One*, 10(4): e0119559 (2015).

Wang et al., Bioengineering of artificial sntigen presenting cells and lymphoid organs. *Theranostics*, 7(14): 3504-16 (2017).

Wolff et al., Direct gene transfer into mouse muscle in vivo. *Science*, 247(4949): 1465-68 (1990).

Wu et al., Adoptive T-cell therapy using autologous tumor-infiltrating lymphocytes for metastatic melanoma: current status and future outlook. *Cancer J.*, 18(2): 160-75 (2012).

Yarchoan et al., Targeting neoantigens to augment antitumour immunity. *Nat. Rev. Cancer.*, 17(4): 209-22 (2017).

Zhao et al., TSGene 2.0: an updated literature-based knowledgebase for tumor suppressor genes. *Nucl. Acids Res.*, 44(D1): D1023-31 (2016).

* cited by examiner

N25 (expected size 313 bp)

N26 (expected size 379bp)

*Breast cancer*

*Lung cancer*

*Breast cancer*

*Lung cancer*

FIGURE 7B
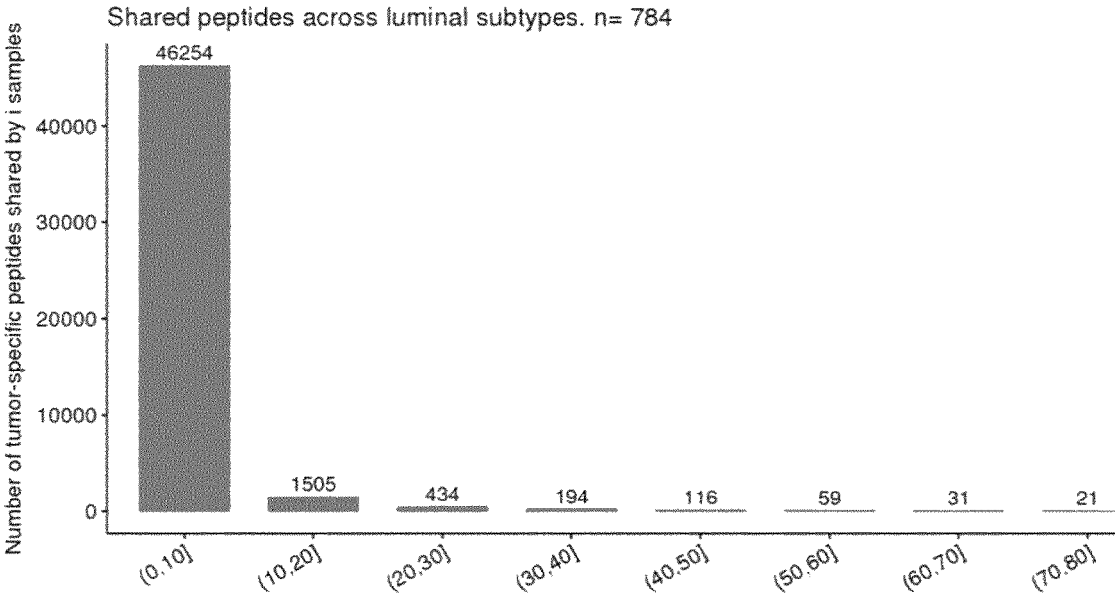
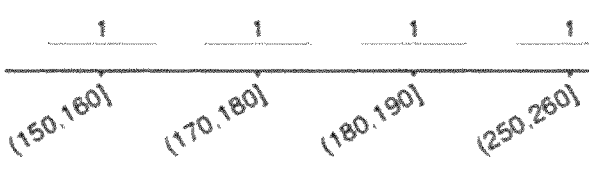

FIGURE 7C
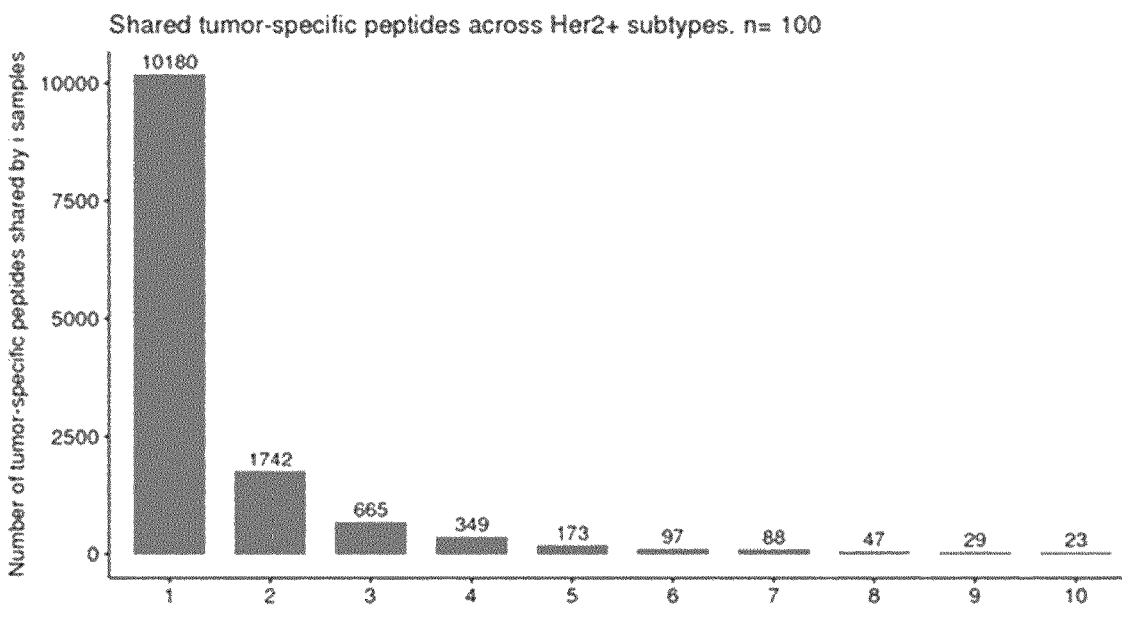
Number of samples
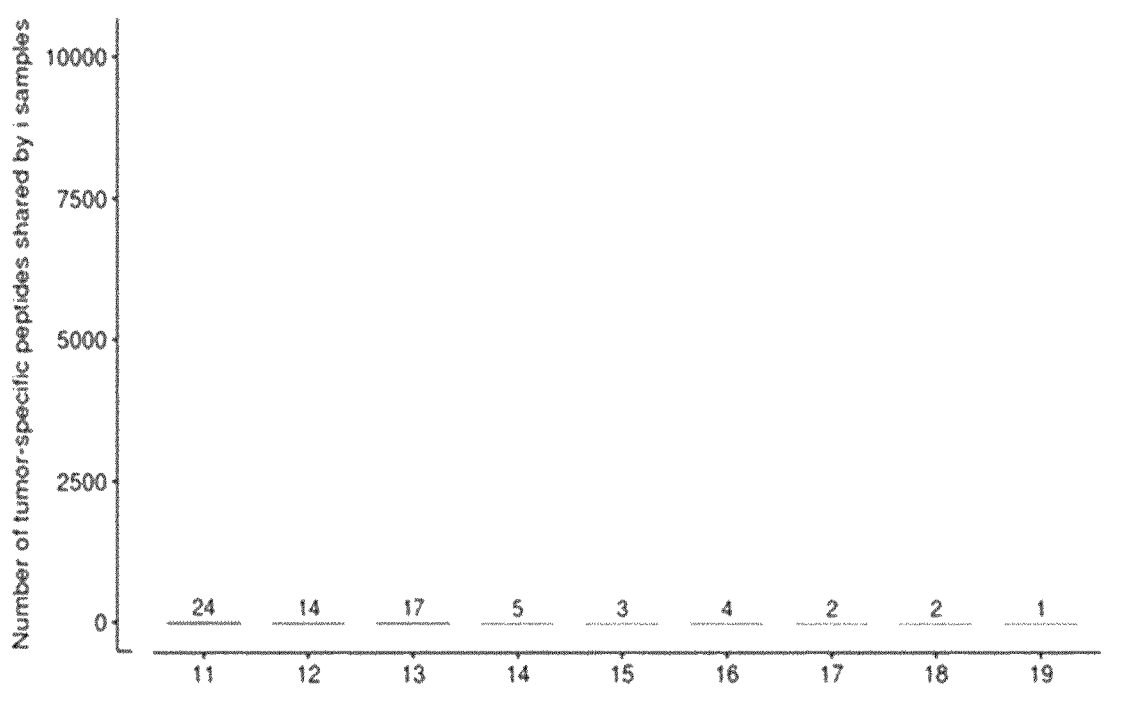
Number of samples

FIGURE 7D
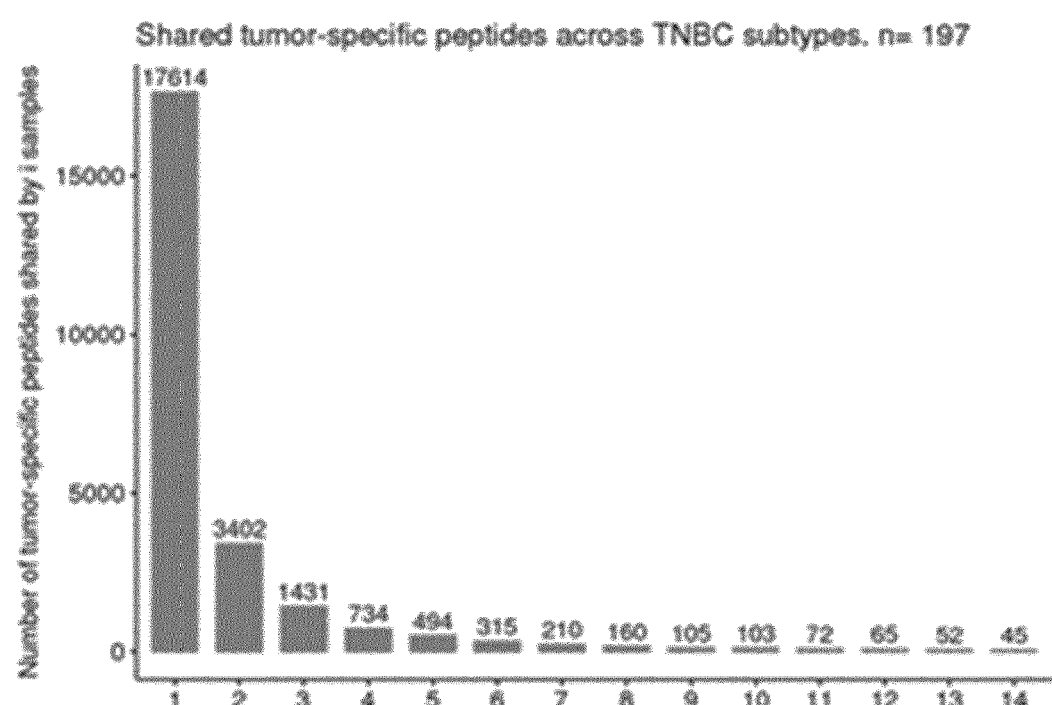
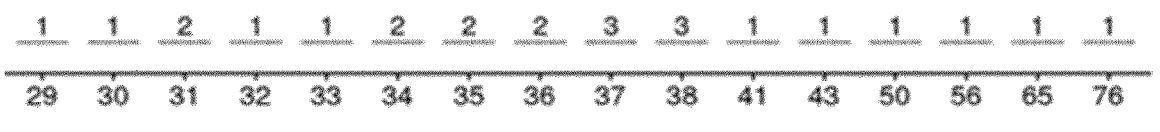
Numbers of samples

FIGURE 8B
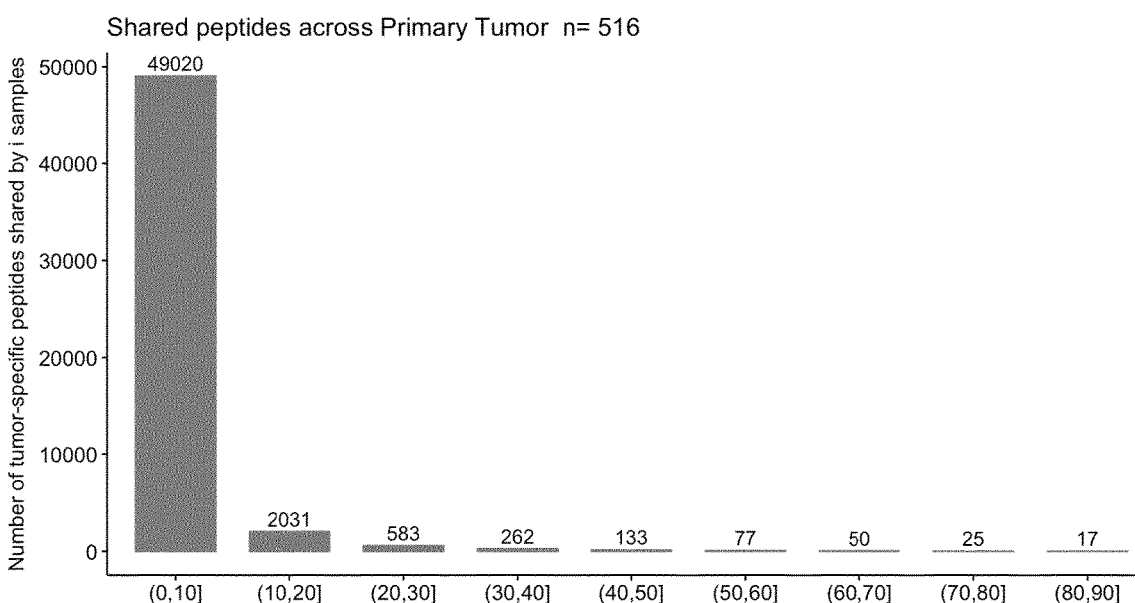
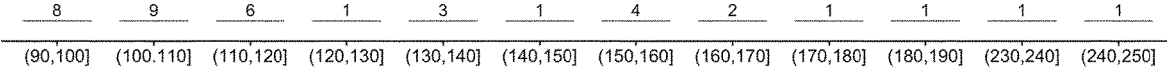
Numbers of samples

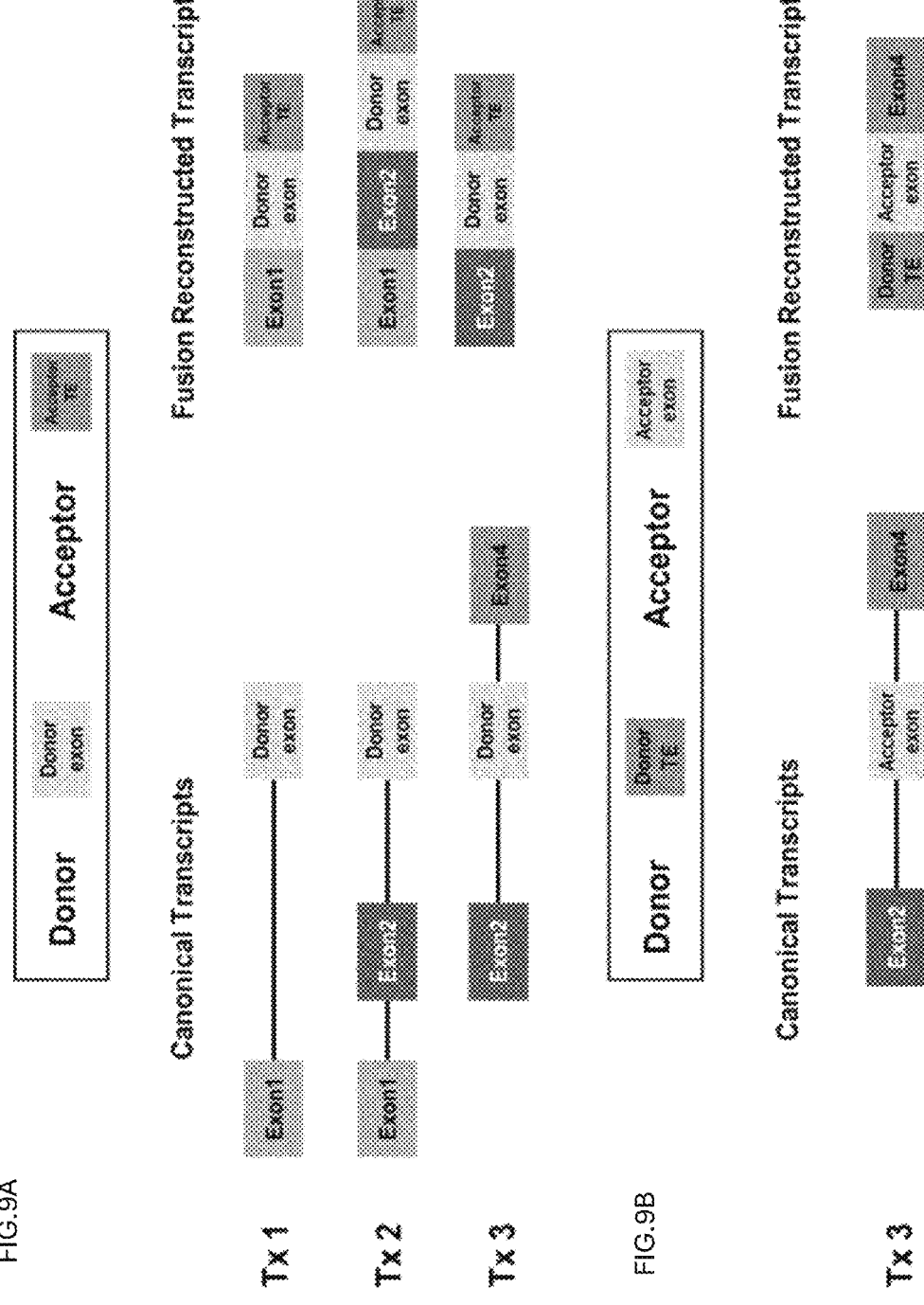

Target cells: H1650

Target cells: H1395

IMMUNOTHERAPY TARGETING TUMOR NEOANTIGENIC PEPTIDES

FIELD OF THE DISCLOSURE

The present disclosure provides neoantigenic peptides encoded by transposable element (TE)-exon fusion transcripts, nucleic acids, vaccines, antibodies and immune cells that can be used in cancer therapy.

INCORPORATION BY REFERENCE

This application includes, as a separate part of disclose, a Sequence Listing in computer-readable form (Filename: SubSeqListing.txt, Size: 26.2 MB; Created: Apr. 20, 2023). The contents of the Sequence Listing text file incorporated herein by reference in their entirety.

BACKGROUND

Harnessing the immune system to generate effective responses against tumors is a central goal of cancer immunotherapy. Part of the effective immune response involves T lymphocytes specific for tumor antigens. T cell activation requires their interaction with antigen-presenting cells (APCs), commonly dendritic cells (DCs), expressing TCR-cognate peptides presented in the context of a major histocompatibility molecule (MHC) and co-stimulation signals. Subsequently, activated T cells can recognize peptide-MHC complexes presented by all cell types, even malignant cells. Neoplasms often contain infiltrating T lymphocytes reactive with tumor cells.

However, the efficiency of immune responses against tumors is severely dampened by various immunosuppressive strategies developed by tumors; e.g, tumor cells express receptors that provide inhibitory signals to infiltrating T cells, or they secrete inhibitory cytokines. The development of checkpoint blockade therapy has provided means to bypass some of these mechanisms, leading to more efficient killing of cancer cells. The promising results yielded by this approach have opened up new avenues for the development of T cell-based immunotherapy. Checkpoint inhibitors are, however, effective in a minority of patients and only in limited types of cancer.

A major goal in immunotherapy is to increase the proportion of responding patients and extend the cancer indications. Vaccination, administration of anti-tumor antibodies, or administration of immune cells specific for tumor antigens have all been proposed to increase the anti-tumor immune response, and can be administered alone, with other therapies such as chemotherapy or radiation, or as a combination therapy with checkpoint blockers. The selection of antigens able to trigger anti-tumor immunity without targeting healthy tissues has been a long-standing challenge.

The search for tumor neoantigens has mostly been focused on mutated sequences appearing as in cancer cells. These antigens are unique to each patient. Tumor antigens (the ones preferentially expressed in tumor cells) are, however, self-antigens that represent poor targets for vaccination (probably due to central tolerance). Identifying shared true neoantigens (absent from tissues) is a major challenge for the field.

A few prior reports regarding transposable elements (TE) in tumors include (Helman, E. et al. (2014). *Genome Res.*) (Schiavetti, F. et al. (2002). *Cancer Res.*, Takahashi, Y. et al. (2008). *J Clin. Invest.*). (Chiappinelli, K. B. et al. (2015). *Cell*, Roulois, D. et al. (2015). *Cell*). However, the relationship of TE to the antigenic landscape presented by tumor cells has not been investigated in depth.

New tumor neoantigens would be of interest and might improve or reduce the cost of cancer therapy in particular in the case of vaccination and adoptive cell therapy.

SUMMARY

The present disclosure provides a tumor neoantigenic peptide comprising at least 8 amino acids, wherein said neoantigenic peptide is encoded by a part of an open reading frame (ORF) from a fusion transcript sequence comprising a transposable element (TE) sequence and an exonic sequence.

Typically said ORF may
overlaps the junction between the TE and the exonic sequence,
be pure TE, and/or
be non-canonical.

The present disclosure also provides a method for selecting a tumor neoantigenic peptide which comprises:

a step of identifying, among mRNA sequences from cancer cells of a subject, a fusion transcript sequence comprising a transposable element (TE) sequence and exonic sequence, including an open reading frame (ORF), and a step of selecting a tumor neoantigenic peptide of at least 8 amino acids, encoded by a part of said ORF of the fusion transcript sequence, wherein said ORF overlaps the junction between the TE and the exonic sequence, is pure TE and/or is non-canonical, and wherein said tumor neoantigenic peptide binds to at least one Major Histocompatibility Complex (MHC) molecule of said subject.

In one embodiment, the tumor neoantigenic peptide is 8 or 9 amino acids long, notably 8 to 11, and binds to at least one MHC class I molecule.

In another embodiment, the tumor neoantigenic peptide is from 13 to 25 amino acids long, and binds to at least one MHC class II molecule of said subject.

According to the present disclosure, "neoantigen peptide characteristics" include:

the TE sequence can be located in 5' end of the fusion transcript sequence and the exonic sequence can be located in 3' end of the fusion transcript sequence, and the part of the ORF of said fusion transcript sequence, which encodes the neoantigenic peptide, can overlap the junction;

the TE sequence can be located in 5' end of the fusion transcript sequence and the exonic sequence can be located in 3' end of the fusion transcript sequence, and the part of ORF which encodes said tumor neoantigenic peptide, can be downstream of the junction such that the open reading frame is non-canonical;

the TE sequence can be located in 3' end of the fusion transcript sequence and the exonic sequence can be located in 5' end of the fusion transcript sequence and the part of the ORF of said fusion transcript sequence, which encodes the tumor neoantigenic peptide, can overlap the junction; or the TE sequence is located in 3' end of the fusion transcript sequence and the exonic sequence is located in 5' end of the chimeric transcript sequence, the part of the ORF which encodes a tumor neoantigenic peptide, is downstream of the junction between the exonic sequence and the TE sequence, optionally wherein the peptide sequence which is thus encoded by the pure TE sequence is non-canonical.

The TE sequences can be selected from the TE class I: Endogenous RetroVirus (ERVs), Long interspersed nuclear elements (LINEs) and short interspersed nuclear element (SINEs) and MaLR sequences or the DNA transposons of class II.

The present disclosure also encompasses peptides obtainable by the method as herein disclosed.

The present disclosure also provides neoantigenic peptides, comprising at least 8 amino acids and encoded by an open reading frame (ORF) of any one of the fusions transcripts of any of SEQ ID NO: 118-17492, preferably a peptide with one or more of the neoantigen peptide characteristics described above. More particularly neoantigenic peptide comprising at least 8 amino acids of any of SEQ ID NO: 1-117 are herein provided.

Said neoantigenic peptides are typically expressed at higher levels, or higher frequency, in tumor samples compared to normal, optionally said neoantigenic peptides are not expressed in normal tissue samples (i.e. normal healthy cells), or not detectably expressed in normal healthy samples.

In some embodiments said neoantigenic peptides are expressed in at least 1%, 5%, 10%, 15%, 20% 25% or even at least 30% of subjects from a population of subjects suffering from cancer and notably from a population of subjects suffering from cancer, notably from lung cancer, more particularly Non-small cell lung cancer (NSCLC), even more particularly from lung adenocarcinoma (LUAD).

Typically, the neoantigenic peptides bind MHC class I or class II with a binding affinity Kd of less than about $10^{-4}$, $10^{-5}$, $10^{-6}$, $10^{-7}$, $10^{-8}$ or $10^{-9}$ M (lower numbers indicating higher binding affinity).

Typically, the neoantigenic peptides bind MHC class I with a binding affinity of less than 2% percentile rank score predicted by NetMHCpan 4.0 Typically, the neoantigenic peptides bind MHC class II with a binding affinity of less than 10% percentile rank score predicted by NetMHCpanII 3.2.

The present disclosure also encompasses:
a population of autologous dendritic cells or antigen presenting cells that have been pulsed with one or more of the peptides as herein defined, or transfected with a polynucleotide encoding one or more of the peptides as herein described;
a vaccine or immunogenic composition, notably a sterile vaccine or immunogenic composition, capable of raising a specific T-cell response comprising
  a. one or more neoantigenic peptides as herein defined,
  b. one or more polynucleotides encoding a neoantigenic peptide as herein defined, optionally wherein the one or more polynucleotides are linked to a heterologous regulatory control nucleotide sequence; or
  c. a population of autologous dendritic cells or antigen presenting cells (notably artificial APC) that have been pulsed or loaded with one or more of the peptides as herein defined,
optionally in combination with a physiologically or pharmacologically acceptable buffer, carrier, excipient, immunostimulant and/or adjuvant.
an antibody, or an antigen-binding fragment thereof, a T cell receptor (TCR), or a chimeric antigen receptor (CAR) that has been selected for its binding affinity to a neoantigenic peptide as herein defined, or a composition comprising such antibody, antigen-binding fragment thereof, TCR or CAR.
a polynucleotide encoding a neoantigenic peptide, an antibody, a CAR or a TCR as herein defined, typically operatively linked to a heterologous regulatory control nucleotide sequence, and a vector encoding such polynucleotide, or a vaccine or immunogenic composition comprising such polynucleotide or vector;
an immune cell, or a population or immune cells that targets one or more neoantigenic peptides, as herein defined, wherein the population of immune cells preferably targets a plurality of different tumor neoantigenic peptides as herein disclosed, or a composition comprising such immune cells or population of immune cells optionally in combination with a physiologically or pharmacologically acceptable buffer, carrier, excipient, immunostimulant and/or adjuvant.

Typically, the antibody or antigen-binding fragment thereof, TCR or CAR binds a neoantigenic peptide, optionally in association with an MHC molecule, with a Kd affinity of about $10^{-6}$ M or less.

In some embodiments, the T cell receptor can be made soluble and fused to an antibody fragment directed to a T cell antigen, optionally wherein the targeted antigen is CD3 or CD16.

In some embodiments, the antibody can be a multispecific antibody that further targets at least an immune cell antigen, optionally wherein the immune cell is a T cell, a NK cell or a dendritic cell, optionally wherein the targeted antigen is CD3, CD16, CD30 or a TCR. In any of the embodiments relating to an antibody, the antibody can be chimeric, humanized, or human, and may be IgG, e.g. IgG1, IgG2, IgG3, IgG4.

The immune cell can be typically a T cell or a NK cell, a CD4+ and/or CD8+ cell, a TILs/tumor derived CD8 T cells, a central memory CD8+ T cells, a Treg, a MAIT, or a Yδ T cell. The cell can also be autologous or allogenic.

The T cell can comprises comprise a recombinant antigen receptor selected from T cell receptor and chimeric antigen receptor as herein defined, wherein the antigen is a tumor neoantigenic receptor as herein disclosed.

The present disclosure also encompasses a method of producing an antibody, TCR or CAR that specifically binds a neoantigenic peptide as herein defined and comprising the step of selecting an antibody, TCR or CAR that binds to a tumor neoantigen peptide of the present disclosure, optionally in association with an MHC or HLA molecule, optionally with a Kd binding affinity of about $10^{-6}$ M or less. Antibodies, TCRs and CARs selected by said method are also part of the present application, and thus any references to antibodies, TCRs or CARs herein also means an antibody, TCR or CAR that has been selected by said method.

A polynucleotide encoding a neoantigenic peptide as herein defined, or encoding an antibody, a CAR or a TCR as herein defined, optionally linked to a heterologous regulatory control sequence are also part of the present application.

As per the present disclosure, the neoantigenic peptide, the population of dendritic cells, the vaccine or immunogenic composition, the polynucleotide or the vector encoding the peptide can be used in cancer vaccination therapy of a subject; or for treating cancer in a subject suffering from cancer or at risk of cancer; or can be used for inhibiting proliferation of cancer cells. Typically the peptide(s) bind at least one MHC molecule of said subject.

As per the present disclosure, the antibody or the antigen-binding fragment thereof, the multispecific antibody, the TCR, the CAR, the polynucleotide, or the vector encoding such antibody, TCR or CAR, as herein defined can be used in the treatment of cancer in a subject in need thereof, the subject suffering from cancer or at risk of cancer, or can be used for inhibiting proliferation of cancer cells. Still as per the present disclosure, the population of immune cells as herein defined can be used in cell therapy of a subject suffering from cancer or at risk of cancer, or can be used for inhibiting proliferation of cancer cells.

Particularly, the neoantigenic peptide, the population of dendritic cells, the vaccine or immunogenic composition, the polynucleotide or the vector encoding the peptide, the antibody or the antigen-binding fragment thereof, the multispecific antibody, the TCR, the CAR, the polynucleotide, or the vector encoding such antibody, TCR or CAR or the population of immune cells (collectively referenced herein as the "Cancer Therapeutic Products") are used in the treatment of a subject who is suffering from NSCLC or who is at risk of suffering from NSCLC and/or in the treatment of NSCLC.

Pharmaceutical compositions comprising any of the foregoing, optionally with a sterile pharmaceutically acceptable excipient(s), carrier, and/or buffer are also contemplated as well as methods of using them.

In any of the embodiments described herein, the Cancer Therapeutic Products as above defined can be administered in combination with at least one further therapeutic agent. Such further therapeutic agent can typically be a chemotherapeutic agent, or an immunotherapeutic agent.

For example, according to the present disclosure, any of the Cancer Therapeutic Products can be administered in combination with an anti-immunosuppressive/immunostimulatory agent. For example, the subject is further administered with one or more checkpoint inhibitors typically selected from PD-1 inhibitors, PD-L1 inhibitors, Lag-3 inhibitors, Tim-3 inhibitors, TIGIT inhibitors, BTLA inhibitors, V-domain Ig suppressor of T-cell activation (VISTA) inhibitors and CTLA-4 inhibitors, or IDO inhibitors.

Various embodiments of the methods, neoantigenic peptides and Cancer Therapeutic Products are described in detailed below. Except for alternatives clearly mentioned, combinations of such embodiments are encompassed by the present application.

DETAILED DISCLOSURE

Transposable elements (TEs) expression in normal tissues is silenced by DNA methylation established early during embryonic development. An additional layer of inhibition is provided by histone modifications. TEs can be re-activated in tumor cells.

The Inventors have developed a method for selecting a tumor neoantigenic peptide encoded by a fusion transcript sequence comprising a part of a TE sequence and a part of an exonic sequence.

The neoantigenic tumor specific peptides identified by the method according to the present disclosure are highly immunogenic. Indeed, because they are derived from a fusion transcripts (composed of a transposable element, TE, and an exonic sequence) absent from normal cells, the peptides of the present disclosure are expected to exhibit very low immunological tolerance.

The present disclosure also allows selecting peptides having shared tumor neoepitopes among a population of patients. Such shared tumor peptides are of high therapeutic interest since they may be used in immunotherapy for a large population of patients.

6

Definitions

According to the present disclosure, the term "disease" refers to any pathological state, including cancer diseases, in particular those forms of cancer diseases described herein.

The term "normal" refers to the healthy state or the conditions in a healthy subject or tissue, i.e., non-pathological conditions, wherein "healthy" preferably means non-cancerous.

Cancer (medical term: malignant neoplasm) is a class of diseases in which a group of cells display uncontrolled growth (division beyond the normal limits), invasion (intrusion on and destruction of adjacent tissues), and sometimes metastasis (spread to other locations in the body via lymph or blood). These three malignant properties of cancers differentiate them from benign tumors, which are self-limited, and do not invade or metastasize. Most cancers form a tumor but some, like leukemia, do not.

Malignant tumor is essentially synonymous with cancer. Malignancy, malignant neoplasm, and malignant tumor are essentially synonymous with cancer.

As used herein, the term "tumor" or "tumor disease" refers to an abnormal growth of cells (called neoplastic cells, tumorigenous cells or tumor cells) preferably forming a swelling or lesion. By "tumor cell" is meant an abnormal cell that grows by a rapid, uncontrolled cellular proliferation and continues to grow after the stimuli that initiated the new growth cease. Tumors show partial or complete lack of structural organization and functional coordination with the normal tissue, and usually form a distinct mass of tissue, which may be either benign, pre-malignant or malignant.

A benign tumor is a tumor that lacks all three of the malignant properties of a cancer. Thus, by definition, a benign tumor does not grow in an unlimited, aggressive manner, does not invade surrounding tissues, and does not spread to non-adjacent tissues (metastasize).

Neoplasm is an abnormal mass of tissue as a result of neoplasia. Neoplasia (new growth in Greek) is the abnormal proliferation of cells. The growth of the cells exceeds, and is uncoordinated with that of the normal tissues around it. The growth persists in the same excessive manner even after cessation of the stimuli. It usually causes a lump or tumor. Neoplasms may be benign, pre-malignant or malignant.

"Growth of a tumor" or "tumor growth" according to the present disclosure relates to the tendency of a tumor to increase its size and/or to the tendency of tumor cells to proliferate.

For purposes of the present disclosure, the terms "cancer" and "cancer disease" are used interchangeably with the terms "tumor" and "tumor disease".

Cancers are classified by the type of cell that resembles the tumor and, therefore, the tissue presumed to be the origin of the tumor. These are the histology and the location, respectively.

According to the present application, cancer may affect any one of the following tissues or organs: breast; liver; kidney; heart, mediastinum, pleura; floor of mouth; lip; salivary glands; tongue; gums; oral cavity; palate; tonsil; larynx; trachea; bronchus, lung; pharynx, hypopharynx, oropharynx, nasopharynx; esophagus; digestive organs such as stomach, intrahepatic bile ducts, biliary tract, pancreas, small intestine, colon; rectum; urinary organs such as bladder, gallbladder, ureter; rectosigmoid junction; anus, anal canal; skin; bone; joints, articular cartilage of limbs; eye and adnexa; brain; peripheral nerves, autonomic nervous system; spinal cord, cranial nerves, meninges; and various parts of the central nervous system; connective, subcutaneous and other soft tissues; retropentoneum, peritoneum; adrenal gland; thyroid gland; endocrine glands and related structures; female genital organs such as ovary, uterus, cervix uteri; corpus uteri, vagina, vulva; male genital organs such as penis, testis and prostate gland; hematopoietic and reticuloendothelial systems; blood; lymph nodes; thymus.

The term "cancer" according to the disclosure therefore comprises leukemias, seminomas, melanomas, teratomas, lymphomas, neuroblastomas, gliomas, rectal cancer, endometrial cancer, kidney cancer, adrenal cancer, thyroid cancer, blood cancer, skin cancer, cancer of the brain, cervical cancer, intestinal cancer, liver cancer, colon cancer, stomach cancer, intestine cancer, head and neck cancer, gastrointestinal cancer, lymph node cancer, esophagus cancer, colorectal cancer, pancreas cancer, ear, nose and throat (ENT) cancer, breast cancer, prostate cancer, cancer of the uterus, ovarian cancer and lung cancer and the metastases thereof. Examples thereof are lung carcinomas, mamma carcinomas, prostate carcinomas, colon carcinomas, renal cell carcinomas, cervical carcinomas, or metastases of the cancer types or tumors described above. The term cancer according to the present disclosure also comprises cancer metastases and relapse of cancer.

The main types of lung cancer are small cell lung carcinoma (SCLC) and non-small cell lung carcinoma (NSCLC). There are three main sub-types of the non-small cell lung carcinomas: squamous cell lung carcinoma, lung adenocarcinoma (LUAD), and large cell lung carcinoma. Adenocarcinomas account for approximately 10% of lung cancers. This cancer usually is seen peripherally in the lungs, as opposed to small cell lung cancer and squamous cell lung cancer, which both tend to be more centrally located.

By "metastasis" is meant the spread of cancer cells from its original site to another part of the body. The formation of metastasis is a very complex process and depends on detachment of malignant cells from the primary tumor, invasion of the extracellular matrix, penetration of the endothelial basement membranes to enter the body cavity and vessels, and then, after being transported by the blood, infiltration of target organs. Finally, the growth of a new tumor, i.e. a secondary tumor or metastatic tumor, at the target site depends on angiogenesis. Tumor metastasis often occurs even after the removal of the primary tumor because tumor cells or components may remain and develop metastatic potential. In one embodiment, the term "metastasis" according to the present disclosure relates to "distant metastasis" which relates to a metastasis which is remote from the primary tumor and the regional lymph node system.

The cells of a secondary or metastatic tumor are like those in the original tumor. This means, for example, that, if ovarian cancer metastasizes to the liver, the secondary tumor is made up of abnormal ovarian cells, not of abnormal liver cells. The tumor in the liver is then called metastatic ovarian cancer, not liver cancer.

A relapse or recurrence occurs when a person is affected again by a condition that affected them in the past. For example, if a patient has suffered from a tumor disease, has received a successful treatment of said disease and again develops said disease said newly developed disease may be considered as relapse or recurrence. However, according to the present disclosure, a relapse or recurrence of a tumor disease may but does not necessarily occur at the site of the original tumor disease. Thus, for example, if a patient has suffered from ovarian tumor and has received a successful treatment a relapse or recurrence may be the occurrence of an ovarian tumor or the occurrence of a tumor at a site different to ovary. A relapse or recurrence of a tumor also includes situations wherein a tumor occurs at a site different to the site of the original tumor as well as at the site of the original tumor. Preferably, the original tumor for which the patient has received a treatment is a primary tumor and the tumor at a site different to the site of the original tumor is a secondary or metastatic tumor.

By "treat" is meant to administer a compound or composition as described herein to a subject in order to prevent or eliminate a disease, including reducing the size of a tumor or the number of tumors in a subject; arrest or slow a disease in a subject; inhibit or slow the development of a new disease in a subject; decrease the frequency or severity of symptoms and/or recurrences in a subject who currently has or who previously has had a disease; and/or prolong, i.e. increase the lifespan of the subject. In particular, the term "treatment of a disease" includes curing, shortening the duration, ameliorating, preventing, slowing down or inhibiting progression or worsening, or preventing or delaying the onset of a disease or the symptoms thereof.

By "being at risk" is meant a subject, i.e. a patient, that is identified as having a higher than normal chance of developing a disease, in particular cancer, compared to the general population. In addition, a subject who has had, or who currently has, a disease, in particular cancer, is a subject who has an increased risk for developing a disease, as such a subject may continue to develop a disease. Subjects who currently have, or who have had, a cancer also have an increased risk for cancer metastases.

The therapeutically active agents, vaccines and compositions described herein may be administered via any conventional route, including by injection or infusion.

The agents described herein are administered in effective amounts. An "effective amount" refers to the amount which achieves a desired reaction or a desired effect alone or together with further doses or together with further therapeutic agents. In the case of treatment of a particular disease or of a particular condition, the desired reaction preferably relates to inhibition of the course of the disease. This comprises slowing down the progress of the disease and, in particular, interrupting or reversing the progress of the disease. The desired reaction in a treatment of a disease or of a condition may also be delay of the onset or a prevention of the onset of said disease or said condition.

An effective amount of an agent described herein will depend on the condition to be treated, the severity of the disease, the individual parameters of the patient, including age, physiological condition, size and weight, the duration of treatment, the type of an accompanying therapy (if present), the specific route of administration and similar factors. Accordingly, the doses administered of the agents described herein may depend on various of such parameters. In the case that a reaction in a patient is insufficient with an initial dose, higher doses (or effectively higher doses achieved by a different, more localized route of administration) may be used.

The pharmaceutical compositions as herein described are preferably sterile and contain an effective amount of the therapeutically active substance to generate the desired reaction or the desired effect.

The pharmaceutical compositions as herein described are generally administered in pharmaceutically compatible amounts and in pharmaceutically compatible preparation. The term "pharmaceutically compatible" refers to a nontoxic material which does not interact with the action of the active component of the pharmaceutical composition. Preparations of this kind may usually contain salts, buffer substances, preservatives, carriers, supplementing immunity-enhancing substances such as adjuvants, e.g. CpG oligonucleotides, cytokines, chemokines, saponin, GM-CSF and/or RNA and, where appropriate, other therapeutically active compounds. When used in medicine, the salts should be pharmaceutically compatible.

In the present application, the terms "fusion transcript" or "chimeric transcripts" are used indifferently as synonyms. A "fusion or a chimeric" "transcript or sequence", as per the present disclosure is defined as a transcript that aligns in part with an exon sequence and in part with a transposable element (TE) sequence and has a normalized number of read greater than $2 \cdot 10^{-6}$. The normalized number of reads is defined as the number of reads that cover the fusion divided by the library size of the sample.

Unless specifically stated or obvious from context, as used herein, the term "about" is to be understood as within a range of normal tolerance in the art, for example within 2 standard deviations of the mean. About can be understood as within 50%, 45%, 40%, 35%, 30%, 25%, 20%, 15%, 10%, 9%, 8%, 7%, 6%, 5%, 4%, 3%, 2%1, %, 0.5%, 0.1%, 0.05%, or 0.01% of the stated value. Unless otherwise clear from context, all numerical values provided herein are modified by the term about.

A "transposable element" is to be understood as both class I (retrotransposons, including those containing LTRs, LINEs and SINEs) and class II (DNA transposons) endogenously part of the genome (i.e.: not from infection). This includes both autonomous and non-autonomous elements from both classes. According to the present disclosure the TE sequences can be for example selected from TE of class I, such as retrotransposons including Endogenous RetroVirus (ERVs), Long interspersed nuclear elements (LINEs) and short interspersed nuclear element (SINEs) and mammalian long terminal repeat transposon (MaLR), and TE of class II, such as DNA transposons endogenously part of the genome.

A reading frame is a way of dividing the sequence of nucleotides in a nucleic acid (DNA or RNA) molecule into a set of consecutive, non-overlapping triplets.

An open reading frame (ORF) is the part of a reading frame that has the ability to be translated into a peptide. An ORF is a continuous stretch of codons that contain a start codon (for example AUG) at a transcription starting site (TSS) and a stop codon (for example UAA, UAG or UGA). An ATG codon within the ORF (not necessarily the first) may indicate where translation starts. The transcription termination site is located after the ORF, beyond the translation stop codon. In eukaryotic genes with multiple exons, ORFs span intron/exon regions, which may be spliced together after transcription of the ORF to yield the final mRNA for protein translation.

A "canonical ORF" as herein intended is a protein coding sequence with specified reading frame within a mRNA sequence which is described or annotated in databases such as for example Ensembl genome/transcriptome/proteome database collection (typically HG19). Typically, a canonical ORF is the same as one of the exons in normal healthy cells.

A "non-canonical ORF" as herein intended is a protein coding sequence with specified reading frame within a mRNA sequence which is not described (i.e. unannotated) in genome databases such as for example in Ensembl genome/transcriptome/proteome database. Typically a non-canonical ORF means thus that the reading frame is shifted compared to the usual reading frame of exons in normal healthy cells. In some embodiments however, a non-canonical can be described in genome databases (such as Ensembl database), but the mRNA sequence represents minor species in normal cells. By minor species it is typically intended less that 5%, notably less than 2%, or preferentially less than 1% species in normal cells.

An exon is any part of a gene that will encode a part of the final mature RNA produced by that gene after introns have been removed by RNA splicing. The term exon refers to both the DNA sequence within a gene and to the corresponding sequence in RNA transcripts. In RNA splicing, introns are removed and exons are covalently joined to one another as part of generating the mature messenger RNA. An exonic sequence as per the present applicant comprises at least a portion of one or more exon. Typically, the exonic sequence comprises at least a portion of one or 2 exons.

Thus, the untranslated sequences in 3'end and in 5' end (3'UTR and 5'UTR) present in mature RNA after splicing are exonic sequences, but are non-coding sequences because these sequences are located upstream of the start codon for the translation (5'UTR) or downstream of the stop codon ending the translation (3'UTR).

The term "peptide or polypeptide," is used interchangeably with "neoantigenic peptide or polypeptide" in the present specification to designate a series of residues, typically L-amino acids, connected one to the other, typically by peptide bonds between the $\alpha$-amino and carboxyl groups of adjacent amino acids. The polypeptides or peptides can be a variety of lengths, either in their neutral (uncharged) forms or in forms which are salts, and either free of modifications such as glycosylation, side chain oxidation, or phosphorylation or containing these modifications, subject to the condition that the modification not destroy the biological activity of the polypeptides as herein described.

A "reference genome, or "representative genome" is a digital nucleic acid sequence data base, assembled by scientists as a representative example of species set of genes. As they are often assembled from the sequencing of DNA from a number of donors, reference genomes do not accurately represent the set of genes of any single individual (animal or person). Instead a reference provides a haploid mosaic of different DNA sequences from each donor.

Method for Selecting a Tumor Neoantigenic Peptide

The method for selecting a tumor neoantigenic peptide as per the present disclosure comprises a step of identifying, among mRNA sequences from a cancer cell sample of a subject, a fusion transcript sequence comprising a transposable element (TE) sequence and an exonic sequence, and including an open reading frame (ORF), and a step of selecting a tumor neoantigenic peptide of at least 8 amino acids, encoded by a part of said ORF of the fusion transcript sequence, wherein said ORF overlaps the junction between the TE and the exonic sequence, is pure TE and/or is non-canonical, and wherein said tumor neoantigenic peptide binds to at least one Major Histocompatibility Complex (MHC) molecule of said subject.

Typically, a peptide translated from a part of non-canonical ORF of an exonic sequence is recognized as non-self by the immune system.

In some embodiments, the exonic sequence is from oncogene and/or a tumor suppressor gene and their mutated variants.

Conceptually, cancer is a result of consecutive somatic mutation accumulation. Many studies have shown that both the gain of function in oncogenes and the loss of function in tumor-suppressor genes are required for the development of cancer from a normal cell. For a diploid organism, gain-of-function mutations are often dominant or semi-dominant, whereas loss-of-function mutations are usually recessive. Two-hit hypothesis of oncogenesis proposes that the development of cancer is initiated by the loss of both alleles of a tumor-suppressor gene.

Oncogenes (also named cancer genes) are genes whose action positively promotes cell proliferation or growth. The normal nonmutant versions are known as proto-oncogenes. The mutant versions are excessively or inappropriately active leading to tumor growth. Oncogenes can be identified in the Cancer Gene Marker Database (CGMD) (Pradeepkiran, J., Sainath, S., Kramthi Kumar, K. et al. CGMD: Sci Rep 5, 12035 (2015) "*An integrated database of cancer genes and markers*"). Oncogenes (ONCs) can also be downloaded from Network of Cancer Genes database (NCG 5.0) (An O, Dall'Olio G M, Mourikis T P, Ciccarelli F D, Nucleic Acids Res. 2016 Jan. 4; 44(D1):D992-9; "*NCG 5.0: updates of a manually curated repository of cancer genes and associated properties from cancer mutational screenings*"). Non-limitatives examples of oncogenes include: L-MYC, LYL-1, LYT-10, LYT-10/Cal, MAS, MDM-2, MLL, MOS, MTG8/AML1, MYB, MYH11/CBFB, NEU, N-MYC, OST, PAX-5, PBX1/E2A, PIM-1, PRAD-1, RAF, RAR/PML, RAS-H, RAS-K, RAS-N, REL/NRG, RET, RHOM1, RHOM2, ROS, SKI, SIS, SET/CAN, SRC, TAL1, TAL2, TAN-1, TIAM1, TSC2, and TRK.

Tumor suppressor genes (also named anti-oncogenes) represent the opposite side of cell growth control, normally acting to inhibit cell proliferation and tumor development. Thus tumor suppressor genes are genes that normally suppress cell division or growth. Loss of TSG function promotes uncontrolled cell division and tumor growth. Rb, a tumor suppressor gene that was identified by the genetic analysis of retinoblastoma an encoding atranscriptional regulatory protein, served as the prototype for the identification of additional tumor suppressor genes that contribute to the development of many different human cancers. Tumor suppressor genes are notably described in "Cooper G M. The Cell: A Molecular Approach. 2nd edition. Sunderland (MA): Sinauer Associates; 2000. Tumor Suppressor Genes". Tumor-suppressor genes (TSGs) can also be downloaded from Tumor Suppressor Gene database (TSGene 2.0) (see for reference Zhao M, Kim P, Mitra R, Zhao J, Zhao Z; Nucleic Acids Res. 2016 Jan. 4; 44(D1):D1023-31; "*TSGene 2.0: an updated literature-based knowledgebase for tumor suppressor genes*"). In this context, non-limitative examples of tumor suppressor genes include: APC, BRCA1, BRCA2, DPC4, INK4, MADR2, NF1, NF2, p53, PTC, PTEN, Rb, RB1, VHL, WTI, BUB1, BUBR1, TGF-βRII, Axin, DPC4, p300, PPARγ, p16, DPC4, PTEN, and hSNF5.

Oncogenes, tumor suppressor genes or "double agent" genes (with both oncogenic and tumor-suppressor functions) can be systematically identified through database search and text mining. Indeed, information on oncogenes or tumor suppressor genes can typically be found in Ensembl database (but see also Shen L, Shi Q, Wang W. Double agents: genes with both oncogenic and tumor-suppressor functions. Oncogenesis. 2018; 7(3):25. Published 2018 Mar. 13). Double agent genes may be identified as genes overlapped between the two above mentioned databases (see also Shen et al., Oncogenesis 2018 above).

Without to be bound by any theory, the inventors believe that selection of fusion wherein the exonic sequence is from an oncogene and/or a tumor suppressor gene is of high relevance for the reason below:

TE insertion in oncogenes can alter their oncogenic activity. Insertion of TE sequences in oncogene active domains could therefore result in constitutive activity of the oncogenes, similar to driver mutations. These fusions giving chimeric oncogenes could thus represent a new family of oncogenic proteins. If this is the case, targeting the activity of these new "fusion oncogenes" with small molecule antagonists could represent a potential therapeutic approach for cancer where these chimeric oncogenes are expressed.

TE insertions in tumor suppressors could inactivate their suppressor functions, leading typically to a loss of function (for example through introduction of stop codons, changes in ORF or disruptive amino acid stretches), thereby contributing to the oncogenic process.

Fusions implicating cancer driver genes would be excellent targets for adoptive cell therapies, antibodies, ADCs, T cell engagers, etc. If they are involved in oncogenesis, fusions oncogenes are expected to be more specific for cancer cells, and thus to reduce the development of resistances (because of the oncogenic activity of the target).

In one embodiment, the TE sequence is located in 5' end of the fusion transcript sequence (it is also said that the TE sequence is the donor sequence) and the exonic sequence is located in 3' end of the fusion transcript sequence with respect to the junction (the exon sequence is thus called an acceptor sequence). The expression "is located in 5' end of the fusion transcript sequence" means that the element is located upstream of the junction in the fusion transcript sequence. The expression "is located in 3' end of the fusion transcript sequence" means that the element is located downstream of the junction in the fusion transcript sequence.

In a particular embodiment, the TE sequence is located in 5' end of the fusion transcript sequence and the exonic sequence is located in 3' end of the fusion transcript sequence, and the part of the ORF of said fusion transcript sequence, which encodes the neoantigenic peptide, overlaps the junction. In this case, the ORF can be canonical or non-canonical. It is understood that the ORF may comprise the junction but the neoantigenic peptide need not comprise the junction. In some embodiments, where the neoantigenic peptide comprises the junction, the obtained peptide is encoded by both TE sequence and exonic sequence.

The expression "the part of the ORF is overlapping or overlaps the junction between the TE sequence and the exonic sequence", means that said junction is contained in the part of the ORF of the fusion transcript sequence, which encodes said neoantigenic peptide.

In embodiments wherein (i) the part of the ORF encoding the neoantigenic peptide is overlapping the junction between the TE sequence and the exonic sequence, and (ii) the TE sequence and the exonic sequence are respectively in 5' end and 3'end of the fusion transcript sequence, said part of the ORF typically encodes a neoantigenic peptide of at least 8 amino acids, including at least between 1 to 6 amino acids, notably 2 to 6 from the TE sequence and at least between 1 and 6, notably 2 to 6 amino acids from the exonic sequence.

In another embodiment wherein the TE sequence is located in 5' end of the fusion transcript sequence and the exonic sequence is located in 3' end of the fusion transcript sequence, the part of ORF which encodes said neoantigenic peptide, is downstream of the junction and the ORF is thus non-canonical.

The expression "the part of the ORF is downstream of the junction" means that the part of the ORF encoding the neoantigenic peptide is not overlapping the junction, but it is contained in the 3'end part of said fusion transcript sequence with respect to the junction. In this embodiment, as the 3' end part with respect to the junction, is the exonic sequence, the part of the ORF encoding the neoantigenic peptide is thus contained in the exonic sequence. Thus, as the part of the ORF is only located in the exonic sequence, the obtained peptide is therefore encoded by the exonic sequence, in a non-canonical ORF. Thus, in the particular embodiment wherein the exonic sequence is located in 3' end of the fusion transcript sequence with respect to the junction, and wherein the part of the ORF which encodes the neoantigenic peptide is downstream of the junction with a non-canonical reading frame, the part of the ORF of the fusion transcript sequence encodes a neoantigenic peptide including 0 amino acid from the TE sequence, and at least 8 amino acids from the exonic sequence.

In another embodiment, the TE sequence is located in 3' end of the fusion transcript sequence and the exonic sequence is located in 5' end of the fusion transcript sequence with respect to the junction.

In some embodiments, the TE sequence is located in 3' end of the fusion transcript sequence and the exonic sequence is located in 5' end of the fusion transcript sequence and the part of the ORF of said fusion transcript sequence, which encodes a neoantigenic peptide, is overlapping the junction between the TE sequence and the exonic sequence. In this case, the ORF can also be canonical or non-canonical. The obtained peptide is encoded by both TE sequence and exonic sequence.

In the particular embodiment wherein the part of the ORF encoding the neoantigenic peptide, is overlapping the junction between the exonic sequence and the TE sequence, and wherein the exonic sequence and the TE sequence are respectively in 5' end and 3'end of the fusion transcript sequence, said part of the ORF encodes a neoantigenic peptide of at least 8 amino acids, including at least between 1 to 6, notably 2 to 6 amino acids from the TE sequence and at least between 1 and 6, notably 2 to 6 amino acids from the exonic sequence.

In still another embodiment, the TE sequence is located in 3' end of the fusion transcript sequence, the exonic sequence is located in 5' end of the fusion transcript sequence, and the part of the ORF which encodes a neoantigenic peptide, is downstream of the junction between the exonic sequence and the TE sequence. Optionally, the peptide sequence which is thus encoded by the pure TE sequence is non-canonical.

In this embodiment, as the 3' end part with respect to the junction is the TE sequence, the part of the ORF encoding the neoantigenic peptide is therefore encoded by the TE sequence. Thus, the part of the ORF encodes a neoantigenic peptide including no amino acid from the exonic sequence and at least 8 amino acids from the TE sequence. In the particular embodiment wherein the TE sequence is located in 3' end of the fusion transcript sequence with respect to the junction, and the part of the ORF which encodes the neoantigenic peptide is downstream the junction, the part of the ORF of the fusion transcript sequence encodes a neoantigenic peptide including 0 amino acid from the exonic sequence, and at least 8 amino acids from the TE sequence.

A tumor neoantigenic peptide is a peptide that arises from somatic alterations (classically mutations in the DNA sequence), is recognized as different from self, and is presented by antigen-presenting cells (APC), such as dendritic cells (DC) and tumor cells themselves. Cross-presentation plays an important role as the APC is able to translocate exogenous antigens from the phagosome into the cytosol for proteolytic cleavage into the major histocompatibility complex I (MHC I) epitopes by the proteasome.

In the present disclosure the alteration corresponds to the transcription of fusion mRNA sequences that comprise a transposable element (TE) sequence and an exonic sequence. This may arise from somatic (i.e.: specifically in the tumor clone) transposition. It may also arise not from de novo transposition but from tumor specific transcriptional de-repression such that a TE and nearby gene are co-transcribed.

A neoantigenic peptide according to the present disclosure may be completely absent from normal healthy samples (i.e., not expressed in normal healthy samples) and thus be specific to tumor samples. Alternatively, it may be expressed at low levels in normal cells and/or disproportionately expressed on tumor samples as compared to normal (healthy) samples.

It can also be selectively expressed by the cell lineage from which the cancer evolved.

Cancer or tumor samples according to the present disclosure can be isolated from any solid tumor or non-solid tumor of any of the tissues or organs as defined previously, for example, breast cancer, lung cancer and/or melanoma. In some embodiments cancer samples are from Acute Myeloid Leukemia, Adrenocortical Carcinoma, Bladder Urothelial Carcinoma, Breast Ductal Carcinoma, Breast Lobular Carcinoma, Cervical Carcinoma, Cholangiocarcinoma, Colorectal Adenocarcinoma, Esophageal Carcinoma, Gastric Adenocarcinoma, Glioblastoma Multiforme, Head and Neck Squamous Cell Carcinoma, Hepatocellular Carcinoma, Kidney Chromophobe Carcinoma, Kidney Clear Cell Carcinoma, Kidney Papillary Cell Carcinoma, Lower Grade Glioma, Lung Adenocarcinoma, Lung Squamous Cell Carcinoma, Mesothelioma, Ovarian Serous Adenocarcinoma, Pancreatic Ductal Adenocarcinoma, Paraganglioma & Pheochromocytoma, Prostate Adenocarcinoma, Sarcoma, Skin Cutaneous Melanoma, Testicular Germ Cell Cancer, Thymoma, Thyroid Papillary Carcinoma, Uterine Carcinosarcoma, Uterine Corpus Endometrioid Carcinoma or Uveal Melanoma samples. In a particular embodiment, cancer samples are from lung cancer samples, notably from LUAD samples.

Typically as per the present disclosure, the step of identifying said fusion transcript sequence is carried out by mapping mRNA sequences from cancer sample against a reference genome, and then distinguishing normal and abnormal junctions.

According to the present disclosure, normal junctions correspond to junctions donor and acceptor on the same strand and not too far apart (e.g.: not on different chromosomes).

According to the present disclosure, abnormal junctions correspond to junctions between donor and acceptor sequences on different chromosomes, or in cis but on different strands (no matter the order and the 5'-3' sense).

In one embodiment, the mRNA sequences can be mapped against a corresponding reference genome, with an adapted software, such as for example: Spliced Transcripts Alignment to a Reference (i.e.: STAR—see Dobin, Alexander et al. "STAR: ultrafast universal RNA-seq aligner." Bioinformatics (Oxford, England) vol. 29, 1 (2013): 15-21), TopHat2 (Kim, Daehwan et al. "TopHat2: accurate alignment of transcriptomes in the presence of insertions, deletions and gene fusions." Genome biology vol. 14, 4 R36. 25 Apr. 2013, doi:10.1186/gb-2013-14-4-r36) or HISAT (Kim, Daehwan et al. "HISAT: a fast spliced aligner with low memory requirements." Nature methods vol. 12, 4 (2015): 357-60. doi:10.1038/nmeth.3317). STAR is a standalone software that uses sequential maximum mappable seed search followed by seed clustering and stitching to align RNA-seq reads. It is able to detect canonical junctions, non-canonical splices, and fusion/chimeric transcripts.

In a particular embodiment, the normal and abnormal junctions are determined in silico using dedicated databases, such as for example Ensembl and Repeatmasker databases, and the fusion transcripts having junctions between a TE and an exonic sequence are extracted in silico.

According to the present disclosure, the mRNA sequences can come from all types of cancer cell or tumor cell sample(s). The tumor may be a solid or a non-solid tumor. In particular, the mRNA sequences come from any tissues or organs affected by a cancer or tumor as previously defined, for example from breast cancer, lung cancer and/or melanoma. In a particular embodiment, mRNA sequences are from LUAD samples.

Typically, as per the present disclosure, the fusion transcript sequences are shared in more than 1%; notably more than 5%, more than 10%, more than 15%, more than 20% or even more than 25% of the cancer samples. In other words, a fusion transcript sequence as per the present disclosure is shared in cancer samples from more than 1%; notably more than 5%, more than 10%, more than 15%, more than 20% or even more than 25% of the subjects suffering from a cancer. The fusion transcript sequence may thus be specific for a cancer type of shared between several cancers.

According to the present disclosure, the fusion transcript sequences are expressed at higher levels in tumor cells compared to normal healthy cells. In some embodiments, the fusion transcript sequence is expressed in cancer cells and not in healthy cells, in particular not in thymus healthy cells. Such fusion transcript may be called tumor specific fusion as per the present disclosure. Fusion transcripts that are expressed at higher level(s) in tumor cells as compared to normal cell, typically that are disproportionally expressed in cancers cells as compared to normal cells as defined above may be called tumor associated fusion transcripts (TAF) as per the present disclosure. Tumor associated fusion transcripts may be selected according to the present application if they are present in more than 10% of the tumor samples and in less than 20% of the normal samples.

In some embodiments, the method further comprises a step of determining, optionally in silico or using in vitro techniques (see notably the example for illustration), the binding affinity of the tumor neoantigenic peptide with at least one MHC molecule of the said subject suffering from a cancer.

MHC class I proteins form a functional receptor on most nucleated cells of the body. There are 3 major MHC class I genes in HLA: HLA-A, HLA-B, HLA-C and three minor genes HLA-E, HLA-F and HLA-G. β2-microglobulin binds with major and minor gene subunits to produce a heterodimer. MHC molecules of class I consist of a heavy chain and a light chain and are capable of binding a peptide of about 8 to 11 amino acids, but usually 8 or 9 amino acids, if this peptide has suitable binding motifs, and presenting it to cytotoxic T-lymphocytes. The binding of the peptide is stabilized at its two ends by contacts between atoms in the main chain of the peptide and invariant sites in the peptide-binding groove of all MHC class I molecules. There are invariant sites at both ends of the groove which bind the amino and carboxy termini of the peptide. Variations in peptide length are accommodated by a kinking in the peptide backbone, often at proline or glycine residues that allow the required flexibility. The peptide bound by the MHC molecules of class I usually originates from an endogenous protein antigen. As an example, the heavy chain of the MHC molecules of class I is typically an HLA-A, HLA-B or HLA-C monomer, and the light chain is β-2-microglobulin, in humans.

There are 3 major and 2 minor MHC class II proteins encoded by the HLA. The genes of the class II combine to form heterodimeric (αβ) protein receptors that are typically expressed on the surface of antigen-presenting cells. The peptide bound by the MHC molecules of class II usually originates from an extracellular or exogenous protein antigen. As an example, the α-chain and the β-chain are in particular HLA-DR, HLA-DQ and HLA-DP monomers, in humans. MHC class II molecules are capable of binding a peptide of about 8 to 20 amino acids, notably from 10 to 25 or from 13 to 25 if this peptide has suitable binding motifs and presenting it to T-helper cells. These peptides lie in an extended conformation along the MHC II peptide-binding groove which (unlike the MHC class I peptide-binding groove) is open at both ends. The peptide is held in place mainly by main-chain atom contacts with conserved residues that line the peptide-binding groove.

When the method is carried out on human samples, the method may comprise a step of determining the patient's class I or class I Major Histocompatibility Complex (MHC, aka human leukocyte antigen (HLA) alleles). It is to be noticed that as MHC alleles for laboratory mice are generally known such that this step may not be necessary in that particular context. In the present application, "MHC molecule" refers to at least one MHC class I molecule or at least one MHC Class II molecule.

A MHC allele database is carried out by analyzing known sequences of MHC I and MHC II and determining allelic variability for each domain. This can be typically determined in silico using appropriate software algorithms well-known in the field. Several tools have been developed to obtain HLA allele information from genome-wide sequencing data (whole-exome, whole-genome, and RNA sequencing data), including OptiType, Polysolver, PHLAT, HLAreporter, HLAforest, HLAminer, and seq2HLA (see Kiyotani K et al., Immunopharmacogenomics towards personalized cancer immunotherapy targeting neoantigens; Cancer Science 2018; 109:542-549). For example, the seq2hla tool (see Boegel S, Lower M, Schafer M, et al. HLA typing from RNA-Seq sequence reads. Genome Med. 2012; 4:102), which is well designed to perform the method as herein disclosed is an in silico method written in python and R, which takes standard RNA-Seq sequence reads in fastq format as input, uses a bowtie index (Langmead B, et al., Ultrafast and memory-efficient alignment of short DNA sequences to the human genome. Genome Biol. 2009, 10: R25-10.1186/gb-2009-10-3-r25) comprising all HLA alleles and outputs the most likely HLA class I and class II genotypes (in 4 digit resolution), a p-value for each call, and the expression of each class.

Typically, the sequences having junctions between a TE and an exonic sequence are extracted in silico. The affinity of all possible peptides encoded by each sequence for each MHC allele from the patient (or mouse) can be for example determined in silico using computational methods to predict peptide binding-affinity to HLA molecules. Indeed, accurate prediction approaches are based on artificial neural networks with predicted $IC_{50}$. For example, NetMHCpan software which has been modified from NetMHC to predict peptides binding to alleles for which no ligands have been reported, is well appropriate to implement the method as herein disclosed (Lundegaard C et al., NetMHC-3.0: accurate web accessible predictions of human, mouse and monkey MHC class I affinities for peptides of length 8-11; Nucleic Acids Res. 2008; 36:W509-W512; Nielsen M et al. NetMHCpan, a method for quantitative predictions of peptide binding to any HLA-A and -B locus protein of known sequence. PLoS One. 2007; 2:e796, but see also Kiyotani K et al., Immunopharmacogenomics towards personalized cancerimmunotherapy targeting neoantigens; Cancer Science 2018; 109: 542-549 and Yarchoan M et al., Nat rev. cancer 2017; 17(4):209-222). NetMHCpan software predicts binding of peptides to any MHC molecule of known sequence using artificial neural networks (ANNs). The method is trained on a combination of more than 180,000 quantitative binding data and MS derived MHC eluted ligands. The binding affinity data covers 172 MHC molecules from human (HLA-A, B, C, E), mouse (H-2), cattle (BoLA), primates (Patr, Mamu, Gogo) and swine (SLA). The MS eluted ligand data covers 55 HLA and mouse alleles.

In example embodiments, neoantigenic peptides encoded by fusion transcripts as above described and a Kd affinity of predicted peptides for MHC alleles of less than $10^{-4}$. $10^{-5}$, $10^{-6}$, $10^{-7}$ M or less than 500 nM, notably less than 50 nM are selected as tumor neoantigenic peptides.

As above mentioned, affinity of the selected peptide for MHC alleles can be determined in silico using appropriate software such as netMHCpan. Thus, in some embodiments, neoantigenic peptides bind MHC class I with a binding affinity of less than 2% percentile rank score predicted by NetMHCpan 4.0. In other embodiments, the neoantigenic peptides bind MHC class II with a binding affinity of less than 10% percentile rank score predicted by NetMHCpanII 3.2.

Affinity can also (alternatively or in addition) be estimated in vitro, for example using MHC tetramer formation assay as described in the results included therein (see example 2, point 2.1 and 2.2.2). Commercial assays for example from ImmunAware® can typically be used by the skilled person (EasYmers® kits are from ImmunAware® are notably used according to their training guide). Typically, binding affinity is determined as a percentage of binding to a positive control. Generally, peptides showing a percentage of binding of at least 30%, notably at least 40% or even at least 50% of the positive control are selected. Typically, the neoantigenic peptide as per the present disclosure, and typically obtainable as per the present method, binds at least one HLA/MHC molecule with an affinity sufficient for the peptide to be presented on the surface of a cell as an antigen. Generally, the neoantigenic peptide has an IC50 affinity of less than $10^{-4}$. or $10^{-5}$, or $10^{-6}$, or $10^{-7}$ or less than 500 nM, at least less than 250 nM, at least less than 200 nM, at least less than 150 nM, at least less than 100 nM, at least less than 50 nM or less for at least one HLA/MHC molecule (lower numbers indicating greater binding affinity), typically a molecule of said subject suffering from a cancer.

Further optional steps according to the present method may thus independently include:
- a step of exclusion of fusion transcripts or predicted peptides expressed at high levels or high frequency on healthy cells. An alignment of the fusion transcript sequence against the RNAseq data of healthy cells, typically allows determining the relative amount of fusion transcript sequence(s) present in healthy cells; In one embodiment, fusion transcripts or predicted peptides expressed on healthy cells are discarded.
- a step to confirm that a tumor neoantigenic peptide is not expressed in healthy cells of the subject. This step can be carried out using typically the Basic local alignment search tool (BLAST) and performing alignment of the sequence of the neoantigenic peptide against the proteome of healthy cells; Preferably, peptides that align against the proteome of normal healthy cells (for example using BLAST) are discarded.
- a step to confirm that the fusion transcript or predicted peptide is expressed in cancer cells of the subject. The presence of the selected fusion transcript sequence in cancer cells can be checked typically by RT-PCR in mRNA extracted from cancer cell sample.

Neoantigenic Peptides, Polynucleotides and Vectors

The present disclosure also relates to an isolated tumor neoantigenic peptide comprising at least 8, 9, 10, 11, or 12 amino acids, encoded by a portion of an open reading frame (ORF) from a fusion transcript that is a human mRNA sequence comprising a transposable element (TE) sequence and an exonic sequence. The peptide may be 8-9, 8-10, 8-11, 12-25, 13-25, 12-20, or 13-20 amino acids in length. Although the ORF overlaps a junction between a TE sequence and an exonic sequence, it is understood that the tumor neoantigenic peptide itself may not comprise the junction.

The present disclosure also more specifically encompasses an isolated tumor neoantigenic peptide encoded by a portion of a human fusion mRNA sequence from a cancer cell, said fusion mRNA comprising a TE sequence and an exonic sequence. In example embodiments the neoantigenic peptide comprising at least 8, 9, 10, 11 or 12 amino acids is encoded by a part of an open reading frame (ORF) of any of the fusion transcript sequences of any one of SEQ ID NO: 118-910, preferably a peptide with one or more of the neoantigen peptide characteristics described above.

The peptide may be 8-9, 8-10, 8-11, 12-25, 13-25, 12-20, or 13-20 amino acids in length and fulfills one or more of the neoantigen peptide characteristics described above. The N-terminus of the peptide of at least 8 amino acids may be encoded by the triplet codon starting at any of nucleotide positions 1, 2, 3, 4, 5, 6, 7, 8, 9, 10, 11, 12, 13, 14, 15, 16, 17, 18, and higher (it being understood that the disclosure contemplates a start position that is any of the integers between 1 and 8000 without having to list every number between 1 and 8000).

A peptide as above defined is typically obtainable according to the method of the present disclosure and thus encompasses one or more of the characteristics as previously described. In particular a neoantigenic peptide as per the present disclosure may exhibit one or a combination of the following further characteristics:
- It binds or specifically binds MHC class I of a subject and is 8 to 11 amino acids, notably 8, 9, 10, or 11 amino acids. Typically the neoantigenic peptide is 8 or 9 amino acids long, and binds to at least one MHC class I molecule of the subject; or alternatively, it binds to at least one MHC class II molecule of said subject and contains from 12 to 25 amino acids, notably is 12, 13, 14, 15, 16, 17, 18, 19, 20, 21, 22, 23, 24 or 25 amino acids long.
- It binds at least one HLA/MHC molecule of said subject suffering from a cancer with an affinity sufficient for the peptide to be presented on the surface of a cell as an antigen. Typically the neoantigenic peptide has an IC50 of less than $10^{-4}$. or $10^{-5}$, or $10^{-6}$, or $10^{-7}$ or less than 500 nM, at least less than 250 nM, at least less than 200 nM, at least less than 150 nM, at least less than 100 nM, at least less than 50 nM or less (lower numbers indicating greater binding affinity).
- It does not induce a significant autoimmune response and/or invoke immunological tolerance when administered to a subject.

It is expressed at higher levels in tumor samples compared to normal healthy samples. Typically, as per the present disclosure, a fusion transcript may be selected if it is present in more than 10% of the tumor samples and in less than 20% of the normal samples. In some embodiments, the neoantigenic is more specifically a tumor specific antigen (TSA), i.e.: it is only expressed in cancer sample and not in normal samples, or is expressed at relatively low levels in normal samples (e.g. the expressed mRNA sequences represent minor species in normal cells from normal samples).

It comprises the junction between the TE sequence and the exonic sequence, in other words it is encoded by a part of a TE sequence and a part of an exonic sequence, the ORF being either canonical or non-canonical or It is encoded by a non-canonical ORF of an exonic sequence or It is encoded by the TE sequence, optionally in a non-canonical ORF A tumor neoantigenic peptide may first be validated by RT transcription analysis of fusion transcripts sequence in tumors cell from a subject. Typically also, immunization with a tumor neoantigenic peptide as per the present disclosure elicits a T cell response In a particular embodiment, the present disclosure encompasses a NSCLC neoantigenic peptide comprising at least 8 amino acids of any one of SEQ ID NOS: 1-117. Typically, said neoantigenic peptides of SEQ ID NOS: 1-117 binds to HLA-A02 with an affinity sufficient for the peptide to be presented on the surface of cells as an antigen. Affinity for MHC alleles can be determined by known techniques in the field and notably in silico or in vitro as exemplified above;

In a particular embodiment, a tumor neoantigenic peptide as per the present disclosure binds to a MHC molecule present in at least 1%, 5%, 10%, 15%, 20%, 25% or more of subjects. Notably, a tumor neoantigenic peptide as herein disclosed is expressed in at least 1%, 5%, 10%, 15%, 20%, 25% of subjects from a population of subjects suffering from cancer.

More particularly, a tumor neoantigenic peptide of the present disclosure is capable of eliciting an immune response against a tumor present in at least 1%, 5%, 10%, 15%, 20%, or 25% of the subjects in the population of subjects suffering from cancer.

As previously defined, cancer may affect any one of the following tissues or organs: breast; liver; kidney; heart; mediastinum, pleura; floor of mouth; lip; salivary glands; tongue; gums; oral cavity; palate; tonsil; larynx; trachea; bronchus, lung; pharynx, hypopharynx, oropharynx, nasopharynx; esophagus; digestive organs such as stomach, intrahepatic bile ducts, biliary tract, pancreas, small intestine, colon; rectum; urinary organs such as bladder, gallbladder, ureter; rectosigmoid junction; anus, anal canal; skin; bone; joints, articular cartilage of limbs; eye and adnexa; brain; peripheral nerves, autonomic nervous system; spinal cord, cranial nerves, meninges; and various parts of the central nervous system; connective, subcutaneous and other soft tissues; retroperitoneum, peritoneum; adrenal gland; thyroid gland; endocrine glands and related structures; female genital organs such as ovary, uterus, cervix uteri; corpus uteri, vagina, vulva; male genital organs such as penis, testis and prostate gland; hematopoietic and reticuloendothelial systems; blood; lymph nodes; thymus. For example, the tumors or cancers as per the present application includes leukemias, seminomas, melanomas, teratomas, lymphomas, neuroblastomas, gliomas, rectal cancer, endometrial cancer, kidney cancer, adrenal cancer, thyroid cancer, blood cancer, skin cancer, cancer of the brain, cervical cancer, intestinal cancer, liver cancer, colon cancer, stomach cancer, intestine cancer, head and neck cancer, gastrointestinal cancer, lymph node cancer, esophagus cancer, colorectal cancer, pancreas cancer, ear, nose and throat (ENT) cancer, breast cancer, prostate cancer, cancer of the uterus, ovarian cancer and lung cancer and the metastases thereof. Examples thereof are lung carcinomas, mamma carcinomas, prostate carcinomas, colon carcinomas, renal cell carcinomas, cervical carcinomas, or metastases of the cancer types or tumors described above. The term cancer according to the present disclosure also comprises cancer metastases and relapse of cancer.

Typically a neoantigenic peptide as per the present disclosure does not induce a significant autoimmune response and/or invoke immunological tolerance when administered to a subject. Tolerating mechanisms involve clonal deletion, ignorance, anergy, or suppression in the host w the reduction in the number of high-affinity self-reactive T cells.

The neoantigenic peptide can also be modified by extending or decreasing the compound's amino acid sequence, e.g., by the addition or deletion of amino acids. The peptides can also be modified by altering the order or composition of certain residues, it being readily appreciated that certain amino acid residues essential for biological activity, e.g., those at critical contact sites or conserved residues, may generally not be altered without an adverse effect on biological activity. The non-critical amino acids need not be limited to those naturally occurring in proteins, such as L-α-amino acids, or their D-isomers, but may include non-natural amino acids as well, such as β-γ-δ-amino acids, as well as many derivatives of L-α-amino acids.

Typically, a series of peptides with single amino acid substitutions are employed to determine the effect of electrostatic charge, hydrophobicity, etc. on binding. For instance, a series of positively charged (e.g., Lys or Arg) or negatively charged (e.g., Glu) amino acid substitutions are made along the length of the peptide revealing different patterns of sensitivity towards various MHC molecules and T cell receptors. In addition, multiple substitutions using small, relatively neutral moieties such as Ala, Gly, Pro, or similar residues may be employed. The substitutions may be homo-oligomers or hetero-oligomers. The number and types of residues which are substituted or added depend on the spacing necessary between essential contact points and certain functional attributes which are sought (e.g., hydrophobicity versus hydrophilicity). Increased binding affinity for an MHC molecule or T cell receptor may also be achieved by such substitutions, compared to the affinity of the parent peptide. In any event, such substitutions should employ amino acid residues or other molecular fragments chosen to avoid, for example, steric and charge interference which might disrupt binding.

Amino acid substitutions are typically of single residues. Substitutions, deletions, insertions or any combination thereof may be combined to arrive at a final peptide. Substitutional variants are those in which at least one residue of a peptide has been removed and a different residue inserted in its place. Such substitutions are generally made in accordance with the following Table 1 when it is desired to finely modulate the characteristics of the peptide.

TABLE 1

| Original residue | Exemplary substitution |
| --- | --- |
| Ala | Ser |
| Arg | Lys, His |
| Asn | Gln |
| Asp | Glu |
| Cys | Ser |
| Gln | Asn |
| Glu | Asp |
| Gly | Pro |
| His | Lys, Arg |
| Ile | Leu, Val |
| Leu | Ile, Val |
| Lys | Tyr, Trp |
| Met | Thr |
| Phe | Ser |
| Ser | Tyr, Phe |
| Tyr | Trp, Phe |
| Val | Ile, Leu |
| Pro | Gly |

Substantial changes in function (e.g., affinity for MHC molecules or T cell receptors) are made by selecting substitutions that are less conservative than those in above Table, i.e., selecting residues that differ more significantly in their effect on maintaining (a) the structure of the peptide backbone in the area of the substitution, for example as a sheet or helical conformation, (b) the charge or hydrophobicity of the molecule at the target site or (c) the bulk of the side chain. The substitutions which in general are expected to produce the greatest changes in peptide properties will be those in which (a) hydrophilic residue, e.g. seryl, is substituted for (or by) a hydrophobic residue, e.g. leucyl, isoleucyl, phenylalanyl, valyl or alanyl; (b) a residue having an electropositive side chain, e.g., lysl, arginyl, or histidyl, is substituted for (or by) an electronegative residue, e.g. glutamyl or aspartyl; or (c) a residue having a bulky side chain, e.g. phenylalanine, is substituted for (or by) one not having a side chain, e.g., glycine.

The peptides and polypeptides may also comprise isosteres of two or more residues in the neoantigenic peptide or polypeptides. An isostere as defined here is a sequence of two or more residues that can be substituted for a second sequence because the steric conformation of the first sequence fits a binding site specific for the second sequence. The term specifically includes peptide backbone modifications well known to those skilled in the art. Such modifications include modifications of the amide nitrogen, the α-carbon, amide carbonyl, complete replacement of the amide bond, extensions, deletions or backbone crosslinks. See, generally, Spatola, Chemistry and Biochemistry of Amino Acids, Peptides and Proteins, Vol. VII (Weinstein ed., 1983).

In addition, the neoantigenic peptide may be conjugated to a carrier protein, a ligand, or an antibody. Half-life of the peptide may be improved by PEGylation, glycosylation, polysialylation, HESylation, recombinant PEG mimetics, Fc fusion, albumin fusion, nanoparticle attachment, nanoparticulate encapsulation, cholesterol fusion, iron fusion, or acylation.

Modifications of peptides and polypeptides with various amino acid mimetics or unnatural amino acids are particularly useful in increasing the stability of the peptide and polypeptide in vivo. Stability can be assayed in a number of ways. For instance, peptidases and various biological media, such as human plasma and serum, have been used to test stability. See, e.g., Verhoef et al., Eur. J. Drug Metab Pharmacokin. 11:291-302 (1986). Half life of the peptides of the present disclosure is conveniently determined using a 25% human serum (v/v) assay. The protocol is generally as follows. Pooled human serum (Type AB, non-heat inactivated) is delipidated by centrifugation before use. The serum is then diluted to 25% with RPMI tissue culture media and used to test peptide stability. At predetermined time intervals a small amount of reaction solution is removed and added to either 6% aqueous trichloracetic acid or ethanol. The cloudy reaction sample is cooled (4° C.) for 15 minutes and then spun to pellet the precipitated serum proteins. The presence of the peptides is then determined by reversed-phase HPLC using stability-specific chromatography conditions.

The peptides and polypeptides may be modified to provide desired attributes other than improved serum half-life. For instance, the ability of the peptides to induce CTL activity can be enhanced by linkage to a sequence which contains at least one epitope that is capable of inducing a T helper cell response. Particularly preferred immunogenic peptides/T helper conjugates are linked by a spacer molecule. The spacer is typically comprised of relatively small, neutral molecules, such as amino acids or amino acid mimetics, which are substantially uncharged under physiological conditions. The spacers are typically selected from, e.g., Ala, Gly, or other neutral spacers of nonpolar amino acids or neutral polar amino acids. It will be understood that the optionally present spacer need not be comprised of the same residues and thus may be a hetero- or homo-oligomer. When present, the spacer will usually be at least one or two residues, more usually three to six residues. Alternatively, the peptide may be linked to the T helper peptide without a spacer.

The neoantigenic peptide may be linked to the T helper peptide either directly or via a spacer either at the amino or carboxy terminus of the peptide. The amino terminus of either the neoantigenic peptide or the T helper peptide may be acylated. Exemplary T helper peptides include tetanus toxoid 830-843, influenza 307-319, malaria circumsporozoite 382-398 and 378-389

Multiple neoantigenic peptides described herein can also be linked together, optionally by a spacer.

Proteins or peptides may be made by any technique known to those of skill in the art, including the expression of proteins, polypeptides or peptides through standard molecular biological techniques, the isolation of proteins or peptides from natural sources, or the chemical synthesis of proteins or peptides. The nucleotide and protein, polypeptide and peptide sequences corresponding to various genes have been previously disclosed, and may be found at computerized databases known to those of ordinary skill in the art. One such database is the National Center for Biotechnology Information's Genbank and GenPept databases located at the National Institutes of Health website. The coding regions for known genes may be amplified and/or expressed using the techniques disclosed herein or as would be known to those of ordinary skill in the art. Alternatively, various commercial preparations of proteins, polypeptides and peptides are known to those of skill in the art.

In a further aspect the present disclosure provides a nucleic acid (e.g. polynucleotide) encoding a neoantigenic peptide as herein disclosed. The polynucleotide may be selected from DNA, cDNA, PNA, CNA, RNA, either single- and/or double-stranded, or native or stabilized forms of polynucleotides, such as for example polynucleotides with a phosphorothiate backbone, or combinations thereof and it may or may not contain introns so long as it codes for the peptide. Only peptides that contain naturally occurring amino acid residues joined by naturally occurring peptide bonds are encodable by a polynucleotide.

A still further aspect of the disclosure provides an expression vector capable of expressing a neoantigenic peptide as herein disclosed. Expression vectors for different cell types are well known in the art and can be selected without undue experimentation. Generally, the DNA is inserted into an expression vector, such as a plasmid, in proper orientation and correct reading frame for expression. The expression vector will comprise the appropriate heterologous transcriptional and/or translational regulatory control nucleotide sequences recognized by the desired host. The polynucleotide encoding the tumor neoantigenic peptide may be linked to such heterologous regulatory control nucleotide sequences or may be non-adjacent yet operably linked to such heterologous regulatory control nucleotide sequences. The vector is then introduced into the host through standard techniques. Guidance can be found for example in Sambrook et al. (1989) Molecular Cloning, A Laboratory Manual, Cold Spring Harbor Laboratory, Cold Spring Harbor, N.Y.

Antigen Presenting Cells (APCs)

The present disclosure also encompasses a population of antigen presenting cells that have been pulsed with one or more of the peptides as previously defined and/or obtainable in a method as previously described. Preferably, the antigen presenting cells are dendritic cell (DCs) or artificial antigen presenting cells (aAPCs) (see Neal, Lillian R et al. "The Basics of Artificial Antigen Presenting Cells in T Cell-Based Cancer Immunotherapies." Journal of immunology research and therapy vol. 2, 1 (2017): 68-79). Dendritic cells (DC) are professional antigen-presenting cells (APC) that have an extraordinary capacity to stimulate naive T-cells and initiate primary immune responses to pathogens. Indeed, the main role of mature DCs are to sense antigens and produce mediators that activate other immune cells, particularly T cells. DCs are potent stimulators for lymphocyte activation as they express MHC molecules that trigger TCRs (signal 1) and co-stimulatory molecules (signal 2) on T cells. Additionally, DCs also secrete cytokines that support T cell expansion. T cells require presented antigen in the form of a processed peptide to recognize foreign pathogens or tumor. Presentation of peptide epitopes derived from pathogen/tumor proteins is achieved through MHC molecules. MHC class I (MHC-I) and MHC class II (MHC-II) molecules present processed peptides to CD8+ T cells and CD4+ T cells, respectively. Importantly, DCs home to inflammatory sites containing abundant T cell populations to foster an immune response. Thus, DCs can be a crucial component of any immunotherapeutic approach, as they are intimately involved with the activation of the adaptive immune response. In the context of vaccines, DC therapy can enhance T cell immune responses to a desired target in healthy volunteers or patients with infectious disease or cancer. In one embodiment, APCS are artificial APC, which are genetically modified to express the desired T-cell co-stimulatory molecules, human HLA alleles and/or cytokines. Such artificial antigen presenting cells (aAPC) are able to provide the requirements for adequate T-cell engagement, co-stimulation, as well as sustained release of cytokines that allow for controlled T-cell expansion. These cells are not subject to the constraints of time and limited availability and can be stored in small aliquots for subsequent use in generating T-cell lines from different donors, thus representing an off the shelf reagent for immunotherapy applications. Expression of potent co-stimulatory signals on these aAPC endows this system with higher efficiency lending to increased efficacy of adoptive immunotherapy. Furthermore, aAPC can be engineered to express genes directing release of specific cytokines to facilitate the preferential expansion of desirable T-cell subsets for adoptive transfer; such as long lived memory T-cells (see for review Hasan A H et al., Artificial Antigen Presenting Cells: An Off the Shelf Approach for Generation of Desirable T-Cell Populations for Broad Application of Adoptive Immunotherapy; Adv Genet Eng. 2015; 4(3): 130, Kim J V, Latouche J B, Riviere I, Sadelain M. The ABCs of artificial antigen presentation. Nat Biotechnol. 2004; 22:403-410 or Wang C, Sun W, Ye Y, Bomba H N, Gu Z. Bioengineering of Artificial Antigen Presenting Cells and Lymphoid Organs. Theranostics 2017; 7(14):3504-3516.).

Typically, the dendritic cells are autologous dendritic cells that are pulsed with a neoantigenic peptide as herein disclosed. The peptide may be any suitable peptide that gives rise to an appropriate T-cell response. The antigen-presenting cell (or stimulator cell) typically has an MHC class I or II molecule on its surface, and in one embodiment is substantially incapable of itself loading the MHC class I or II molecule with the selected antigen. The MHC class I or II molecule may readily be loaded with the selected antigen in vitro.

As an alternative the antigen presenting cell may comprise an expression construct encoding a tumor neoantigenic peptide as herein disclosed. The polynucleotide may be any suitable polynucleotide as previously defined and it is preferred that it is capable of transducing the dendritic cell, thus resulting in the presentation of a peptide and induction of immunity.

Thus the present disclosure encompasses a population of APCs than can be pulsed or loaded with the neoantigenic peptide as herein disclosed, genetically modified (via DNA or RNA transfer) to express at least one neoantigenic peptide as herein disclosed, or that comprise an expression construct encoding a tumor neoantigenic peptide of the present disclosure. Typically the population of APCs is pulsed or loaded, modified to express or comprises at least one, at least 5, at least 10, at least 15, or at least 20 different neoantigenic peptide or expression construct encoding it.

The present disclosure also encompasses compositions comprising APCs as herein disclosed. APCs can be suspended in any known physiologically compatible pharmaceutical carrier, such as cell culture medium, physiological saline, phosphate-buffered saline, cell culture medium, or the like, to form a physiologically acceptable, aqueous pharmaceutical composition. Parenteral vehicles include sodium chloride solution, Ringer's dextrose, dextrose and sodium chloride, lactated Ringer's. Other substances may be added as desired such as antimicrobials. As used herein, a "carrier" refers to any substance suitable as a vehicle for delivering an APC to a suitable in vitro or in vivo site of action. As such, carriers can act as an excipient for formulation of a therapeutic or experimental reagent containing an APC. Preferred carriers are capable of maintaining an APC in a form that is capable of interacting with a T cell. Examples of such carriers include, but are not limited to water, phosphate buffered saline, saline, Ringer's solution, dextrose solution, serum-containing solutions, Hank's solution and other aqueous physiologically balanced solutions or cell culture medium. Aqueous carriers can also contain suitable auxiliary substances required to approximate the physiological conditions of the recipient, for example, enhancement of chemical stability and isotonicity. Suitable auxiliary substances include, for example, sodium acetate, sodium chloride, sodium lactate, potassium chloride, calcium chloride, sorbitan monolaurate, triethanolamine oleate, and other substances used to produce phosphate buffer, Tris buffer, and bicarbonate buffer.

Vaccine Compositions

The present disclosure further encompasses a vaccine or immunogenic composition capable of raising a specific T-cell response comprising:

one or more neoantigenic peptides as herein defined,
    one or more polynucleotides encoding a neoantigenic peptide as herein defined; and/or
    a population of antigen presenting cells (such as autologous dendritic cells or artificial APC) as described above.

Preferably, neoantigenic peptide which are encoded by tumor specific fusions as previously defined are used in vaccine compositions as per the present disclosure. Said neoantigenic peptide can be also named tumor specific peptides. Preferably also polynucleotides encoding tumor specific peptides are used as per the present disclosure.

A suitable vaccine or immunogenic composition will preferably contain between 1 and 20 neoantigenic peptides, more preferably 2, 3, 4, 5, 6, 7, 8, 9, 10, 11, 12, 13, 14, 15, 16, 17, 18, 19, 20, 21, 22, 23, 24, 25 different neoantigenic peptides, further preferred 6, 7, 8, 9, 10 11, 12, 13, or 14 different neoantigenic peptides, and most preferably 12, 13 or 14 different neoantigenic peptides.

The neoantigenic peptide(s) may be linked to a carrier protein. Where the composition contains two or more neoantigenic peptides, the two or more (e.g. 2-25) peptides may be linearly linked by a spacer molecule as described above, e.g. a spacer comprising 2-6 nonpolar or neutral amino acids.

In one embodiment of the present disclosure the different neoantigenic peptides, encoding polynucleotides, vectors, or APCs are selected so that one vaccine or immunogenic composition comprises neoantigenic peptides capable of associating with different MHC molecules, such as different MHC class I molecules. Preferably, such neoantigenic peptides are capable of associating with the most frequently occurring MHC class I molecules, e.g. different fragments capable of associating with at least 2 preferred, more preferably at least 3 preferred, even more preferably at least 4 preferred MHC class I molecules. In some embodiments, the compositions comprise peptides, encoding polynucleotides, vectors, or APCs capable of associating with one or more MHC class II molecules. The MHC is optionally HLA-A, -B, -C, -DP, -DQ, or -DR.

The vaccine or immunogenic composition is capable of raising a specific cytotoxic T-cells response and/or a specific helper T-cell response.

Thus in a particular embodiment, the present disclosure also relates to a neoantigenic peptide as described above, wherein the neoantigenic peptide has a tumor specific neoepitope and is included in a vaccine or immunogenic composition. A vaccine composition is to be understood as meaning a composition for generating immunity for the prophylaxis and/or treatment of diseases. Accordingly, vaccines are medicines which comprise or generate antigens and are intended to be used in humans or animals for generating specific defense and protective substance by vaccination. An "immunogenic composition" is to be understood as meaning a composition that comprises or generates antigen(s) and is capable of eliciting an antigen-specific humoral or cellular immune response, e.g. T-cell response.

In a preferred embodiment, the neoantigenic peptide according to the disclosure is 8 or 9 residues long, or from 13 to 25 residues long. When the peptide is less than 20 residues, in order to have a peptide better suited for in vivo immunization, said neoantigenic peptide, is optionally flanked by additional amino acids to obtain an immunization peptide of more amino acids, usually more than 20.

Pharmaceutical compositions (i.e., the vaccine or immunogenic composition) comprising a peptide as herein described may be administered to an individual already suffering from cancer. In therapeutic applications, compositions are administered to a patient in an amount sufficient to elicit an effective CTL response to the tumor antigen and to cure or at least partially arrest symptoms and/or complications. An amount adequate to accomplish this is defined as "therapeutically effective dose." Amounts effective for this use will depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 1.0 µg to about 50,000 µg of peptide for a 70 kg patient, followed by boosting dosages or from about 1.0 µg to about 10,000 µg of peptide pursuant to a boosting regimen over weeks to months depending upon the patient's response and condition by measuring specific CTL activity in the patient's blood. It must be kept in mind that the peptide and compositions of the present invention may generally be employed in serious disease states, that is, life-threatening or potentially life threatening situations, especially when the cancer has metastasized. In such cases, in view of the minimization of extraneous substances and the relative nontoxic nature of the peptide, it is possible and may be felt desirable by the treating physician to administer substantial excesses of these peptide compositions.

For therapeutic use, administration should begin at the detection or surgical removal of tumors. This is followed by boosting doses until at least symptoms are substantially abated and for a period thereafter.

The vaccine or immunogenic compositions for therapeutic treatment are intended for parenteral, topical, nasal, oral or local administration. Preferably, the pharmaceutical compositions are administered parenterally, e.g., intravenously, subcutaneously, intradermally, or intramuscularly. The compositions may be administered at the site of surgical excision to induce a local immune response to the tumor.

The vaccine or immunogenic composition may be a pharmaceutical composition which additionally comprises a pharmaceutically acceptable adjuvant, immunostimulatory agent, stabilizer, carrier, diluent, excipient and/or any other materials well known to those skilled in the art. Such materials should be non-toxic and should not interfere with the efficacy of the active ingredient. The carrier is preferably an aqueous carrier but its precise nature of the carrier or other material will depend on the route of administration. A variety of aqueous carriers may be used, e.g., water, buffered water, 0.9% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may further contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc. See, for example, Butterfield, B M J. 2015 22; 350 for a discussion of cancer vaccines.

Example adjuvants that increase or expand the immune response of a host to an antigenic compound include emulsifiers, muramyl dipeptides, avridine, aqueous adjuvants such as aluminum hydroxide, chitosan-based adjuvants, saponins, oils, Amphigen, LPS, bacterial cell wall extracts, bacterial DNA, CpG sequences, synthetic oligonucleotides, cytokines and combinations thereof. Emulsifier include, for example, potassium, sodium and ammonium salts of lauric and oleic acid, calcium, magnesium and aluminum salts of fatty acids, organic sulfonates such as sodium lauryl sulfate, cetyltrhethylammonlum bromide, glycerylesters, polyoxyethylene glycol esters and ethers, and sorbitan fatty acid esters and their polyoxyethylene, acacia, gelatin, lecithin and/or cholesterol. Adjuvants that comprise an oil component include mineral oil, a vegetable oil, or an animal oil. Other adjuvants include Freund's Complete Adjuvant (FCA) or Freund's Incomplete Adjuvant (FIA). Cytokines useful as additional immunostimulatory agents include interferon alpha, interleukin-2 (IL-2), and granulocyte macrophage-colony stimulating factor (GM-CSF), or combinations thereof.

The concentration of peptides as herein described in the vaccine or immunogenic formulations can vary widely, i.e., from less than about 0.1%, usually at or at least about 2% to as much as 20% to 50% or more by weight, and will be selected primarily by fluid volumes, viscosities, etc., in accordance with the particular mode of administration selected.

The peptides as herein described may also be administered via liposomes, which target the peptides to a particular cells tissue, such as lymphoid tissue. Liposomes are also useful in increasing the half-life of the peptides. Liposomes include emulsions, foams, micelles, insoluble monolayers, liquid crystals, phospholipid dispersions, lamellar layers and the like. In these preparations the peptide to be delivered is incorporated as part of a liposome, alone or in conjunction with a molecule which binds to, e.g., a receptor prevalent among lymphoid cells, such as monoclonal antibodies which bind to the CD45 antigen, or with other therapeutic or immunogenic compositions. Thus, liposomes filled with a desired peptide of the invention can be directed to the site of lymphoid cells, where the liposomes then deliver the selected therapeutic/immunogenic peptide compositions. Liposomes for use in the invention are formed from standard vesicle-forming lipids, which generally include neutral and negatively charged phospholipids and a sterol, such as cholesterol. The selection of lipids is generally guided by consideration of, e.g., liposome size, acid lability and stability of the liposomes in the blood stream. A variety of methods are available for preparing liposomes, as described in, e.g., Szoka et al., Ann. Rev. Biophys. Bioeng. 9; 467 (1980), U.S. Pat. Nos. 4,235,871, 4,501,728, 4,501,728, 4,837,028, and 5,019,369.

For targeting to the immune cells, a ligand to be incorporated into the liposome can include, e.g., antibodies or fragments thereof specific for cell surface determinants of the desired immune system cells. A liposome suspension containing a peptide may be administered intravenously, locally, topically, etc. in a dose which varies according to, inter alia, the manner of administration, the peptide being delivered, and the stage of the disease being treated.

For solid compositions, conventional or nanoparticle nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant must, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included as desired, as with, e.g., lecithin for intranasal delivery.

Cytotoxic T-cells (CTLs) recognize an antigen in the form of a peptide bound to an MHC molecule rather than the intact foreign antigen itself. The MHC molecule itself is located at the cell surface of an antigen presenting cell. Thus, an activation of CTLs is only possible if a trimeric complex of peptide antigen, MHC molecule, and antigen presenting cell (APC) is present. Correspondingly, it may enhance the immune response if not only the peptide is used for activation of CTLs, but if additionally APCs with the respective MHC molecule are added. Therefore, in some embodiments the vaccine or immunogenic composition according to the present disclosure alternatively or additionally contains at least one antigen presenting cell, preferably a population of APCs.

The vaccine or immunogenic composition may thus be delivered in the form of a cell, such as an antigen presenting cell, for example as a dendritic cell vaccine. The antigen presenting cells such as a dendritic cell may be pulsed or loaded with a neoantigenic peptide as herein disclosed, may comprise an expression construct encoding a neoantigenic peptide as herein disclosed, or may be genetically modified (via DNA or RNA transfer) to express one, two or more of the herein disclosed neoantigenic peptides, for example at least 2, 3, 4, 5, 6, 7, 8, 9, or 10 neoantigenic peptides.

Suitable vaccines or immunogenic compositions may also be in the form of DNA or RNA relating to neoantigenic peptides as described herein. For example, DNA or RNA encoding one or more neoantigenic peptides or proteins derived therefrom may be used as the vaccine, for example by direct injection to a subject. For example, DNA or RNA encoding at least 2, 3, 4, 5, 6, 7, 8, 9, 10, 11, 12, 13, 14, 15, 16, 17, 18, 19, 20, 21, 22, 23, 24 or 25 neoantigenic peptides or proteins derived therefrom.

A number of methods are conveniently used to deliver the nucleic acids to the patient. For instance, the nucleic acid can be delivered directly, as "naked DNA". This approach is described, for instance, in Wolff et al., Science 247: 1465-1468 (1990) as well as U.S. Pat. Nos. 5,580,859 and 5,589,466. The nucleic acids can also be administered using ballistic delivery as described, for instance, in U.S. Pat. No. 5,204,253. Particles comprised solely of DNA can be administered. Alternatively, DNA can be adhered to particles, such as gold particles.

The nucleic acids can also be delivered complexed to cationic compounds, such as cationic lipids. Lipid-mediated gene delivery methods are described, for instance, in 9618372WOAWO 96/18372; 9324640WOAWO 93/24640; Mannino & Gould-Fogerite, BioTechniques 6(7): 682-691 (1988); U.S. Pat. No. 5,279,833 USARose U.S. Pat. No. 5,279,833; 9106309WOAWO 91/06309; and Felgner et al., Proc. Natl. Acad. Sci. USA 84: 7413-7414 (1987).

Delivery systems may optionally include cell-penetrating peptides, nanoparticulate encapsulation, virus like particles, liposomes, or any combination thereof. Cell penetrating peptides include TAT peptide, herpes simplex virus VP22, transportan, Antp. Liposomes may be used as a delivery system. *Listeria* vaccines or electroporation may also be used.

The one or more neoantigenic peptides may also be delivered via a bacterial or viral vector containing DNA or RNA sequences which encode one or more neoantigenic peptides. The DNA or RNA may be delivered as a vector itself or within attenuated bacteria virus or live attenuated virus, such as vaccinia or fowlpox. This approach involves the use of vaccinia virus as a vector to express nucleotide sequences that encode the peptide of the invention. Upon introduction into an acutely or chronically infected host or into a noninfected host, the recombinant vaccinia virus expresses the immunogenic peptide, and thereby elicits a host CTL response. Vaccinia vectors and methods useful in immunization protocols are described in, e.g., U.S. Pat. No. 4,722,848. Another vector is BCG (Bacille Calmette Guerin). BCG vectors are described in Stover et al. (Nature 351:456-460 (1991)). A wide variety of other vectors useful for therapeutic administration or immunization of the peptides of the invention, e.g., *Salmonella* typhivectors and the like, will be apparent to those skilled in the art from the description herein.

An appropriate mean of administering nucleic acids encoding the peptides as herein described involves the use of minigene constructs encoding multiple epitopes. To create a DNA sequence encoding the selected CTL epitopes (minigene) for expression in human cells, the amino acid sequences of the epitopes are reverse translated. A human codon usage table is used to guide the codon choice for each amino acid. These epitope-encoding DNA sequences are directly adjoined, creating a continuous polypeptide sequence. To optimize expression and/or immunogenicity, additional elements can be incorporated into the minigene design. Examples of amino acid sequence that could be reverse translated and included in the minigene sequence include: helper T lymphocyte, epitopes, a leader (signal) sequence, and an endoplasmic reticulum retention signal. In addition, MHC presentation of CTL epitopes may be improved by including synthetic (e.g. poly-alanine) or naturally-occurring flanking sequences adjacent to the CTL epitopes.

The minigene sequence is converted to DNA by assembling oligonucleotides that encode the plus and minus strands of the minigene. Overlapping oligonucleotides (30-100 bases long) are synthesized, phosphorylated, purified and annealed under appropriate conditions using well known techniques. The ends of the oligonucleotides are joined using T4 DNA ligase. This synthetic minigene, encoding the CTL epitope polypeptide, can then cloned into a desired expression vector.

Standard regulatory sequences well known to those of skill in the art are included in the vector to ensure expression in the target cells. Thus, the DNA or RNA encoding the neoantigenic peptide(s) may typically be operably linked to one or more of:

a promoter that can be used to drive nucleic acid molecule expression. AAV ITR can serve as a promoter and is advantageous for eliminating the need for an additional promoter element. For ubiquitous expression, the following promoters can be used: CMV (notably human cytomegalovirus immediate early promoter (hCMV-IE)), CAG, CBh, PGK, SV40, RSV, Ferritin heavy or light chains, etc. For brain expression, the following promoters can be used: SynapsinI for all neurons, CaMKIIalpha for excitatory neurons, GAD67 or GAD65 or VGAT for GABAergic neurons, etc. Promoters used to drive RNA synthesis can include: Pol III promoters such as U6 or HI. The use of a Pol II promoter and intronic cassettes can be used to express guide RNA (gRNA). Typically, the promoter includes a down-stream cloning site for minigene insertion. For examples of suitable promoters sequences, see notably U.S. Pat. Nos. 5,580,859 and 5,589,466.

Transcriptional transactivators or other enhancer elements, which can also increase transcription activity, e.g. the regulatory R region from the 5' long terminal repeat (LTR) of human T-cell leukemia virus type 1 (HTLV-1) (which when combined with a CMV promoter has been shown to induce higher cellular immune response).

Translation optimizing sequences e.g. a Kozak sequence flanking the AUG initiator codon (ACCAUGG) within mRNA, and codon optimization.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences can also be considered for increasing minigene expression. It has recently been proposed that immunostimulatory sequences (ISSs or CpGs) play a role in the immunogenicity of DNA' vaccines. These sequences could be included in the vector, outside the minigene coding sequence, if found to enhance immunogenicity.

In some embodiments, a bicistronic expression vector, to allow production of the minigene-encoded epitopes and a second protein included to enhance or decrease immunogenicity can be used.

DNA vaccines or immunogenic compositions as herein described can be enhanced by co-delivering cytokines that promote cell-mediated immune responses, such as IL-2, IL-12, IL-18, GM-CSF and IFNγ. CXC chemokines such as IL-8, and CC chemokines such as macrophage inflammatory protein (MIP)-1α, MIP-3α, MIP-3β, and RANTES, may increase the potency of the immune response. DNA vaccine immunogenicity can also be enhanced by co-delivering plasmid-encoded cytokine-inducing molecules (e.g. LeIF), co-stimulatory and adhesion molecules, e.g. B7-1 (CD80) and/or B7-2 (CD86). Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-β) may be beneficial in certain diseases.

Once an expression vector is selected, the minigene is cloned into the polylinker region downstream of the promoter. This plasmid is transformed into an appropriate *E. coli* strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

Purified plasmid DNA can be prepared for injection using a variety of formulations. The simplest of these is reconstitution of lyophilized DNA in sterile phosphate-buffer saline (PBS). A variety of methods have been described, and new techniques may become available. As noted above, nucleic acids are conveniently formulated with cationic lipids. In addition, glycolipids, fusogenic liposomes, peptides and compounds referred to collectively as protective, interactive, non-condensing (PINC) could also be complexed to purified plasmid DNA to influence variables such as stability, intramuscular dispersion, or trafficking to specific organs or cell types.

Vaccines or immunogenic compositions comprising peptides may be administered in combination with vaccines or immunogenic compositions comprising polynucleotide encoding the peptides. For example, administration of peptide vaccine and DNA vaccine may be alternated in a prime-boost protocol. For example, priming with a peptide immunogenic composition and boosting with a DNA immunogenic composition is contemplated, as is priming with a DNA immunogenic composition and boosting with a peptide immunogenic composition.

The present disclosure also encompasses a method for producing a vaccine composition comprising the steps of
   a) Optionally, identifying at least one neoantigenic peptide according to the method as previously described;
   b) producing said at least one neoantigenic peptide, at least one polypeptide encoding neoantigenic peptide (s), or at least a vector comprising said polypeptide(s) as described herein; and
   c) optionally adding physiologically acceptable buffer, excipient and/or adjuvant and producing a vaccine with said at least one neoantigenic peptide, polypeptide or vector.

Another aspect of the present disclosure, is a method for producing a DC vaccine, wherein said DCs present at least one neoantigenic peptide as herein disclosed.

Antibodies TCRs, CARs and Derivatives Thereof

The present disclosure also relates to an antibody or an antigen-binding fragment thereof that specifically binds a neoantigenic peptide as herein defined.

In some embodiments, the neoantigenic peptide is in association with an MHC or HLA molecule.

Typically, said antibody, or antigen-binding fragment thereof binds a neoantigenic peptide as herein defined, alone or optionally in association with an MHC or HLA molecule, with a Kd binding affinity of $10^{-7}$ M or less, $10^{-8}$ M or less, $10^{-9}$ M or less, $10^{-10}$ M or less, or $10^{-11}$ M or less.

To promote the infiltration and recognition of tumor cells by lymphocytes T (LT), another strategy consists in using antibodies capable of recognizing more than one antigenic target simultaneously and more particularly two antigenic targets simultaneously. There are many formats of bispecific antibodies. BiTE (bi-specific T-cell engager) are the first to have been developed. These are proteins of fusion consisting of two scFvs (variable domains heavy VH and light VL chains) from two antibodies linked by a binding peptide: one recognizes the LT marker (CD3+) and the other a tumor antigen. The goal is to favor recruitment and activation of LTs in contact with tumor, thus leading to cell lysis tumor (See review Patrick A. Baeuerle and Carsten Reinhardt; Bispecific T-Cell Engaging Antibodies for Cancer Therapy; Cancer Res 2009; 69: (12). Jun. 15, 2009; and Galaine et al., Innovations & Thérapeutiques en Oncologie, vol. 3-no 3-7, mai-aoGt 2017).

In a particular embodiment, said antibody is a bi-specific T-cell engager that targets a tumor neoantigenic peptide as herein defined, optionally in association with a MHC or an HLA molecule and which further targets at least an immune cell antigen. Typically, the immune cell is a T cell, a NK cell or a dendritic cell. In this context, the targeted immune cell antigen may be for example CD3, CD16, CD30 or a TCR.

The term "antibody" herein is used in the broadest sense and includes polyclonal and monoclonal antibodies, including intact antibodies and functional (antigen-binding) antibody fragments, including fragment antigen binding (Fab) fragments, F(ab')2 fragments, Fab' fragments, Fv fragments, recombinant IgG (rIgG) fragments, variable heavy chain (VH) regions capable of specifically binding the antigen, single chain antibody fragments, including single chain variable fragments (scFv), and single domain antibodies (e.g., VHH antibodies, sdAb, sdFv, nanobody) fragments. The term encompasses genetically engineered and/or otherwise variants modified forms of immunoglobulins, such as intrabodies, peptibodies, chimeric antibodies, fully human antibodies, humanized antibodies, and heteroconjugate antibodies, multispecific, e.g., bispecific, antibodies, diabodies, triabodies, and tetrabodies, tandem di-scFv, tandem tri-scFv. Unless otherwise stated, the term "antibody" should be understood to encompass functional antibody and fragments thereof. The term also encompasses intact or full-length antibodies, including antibodies of any class or sub-class, including IgG and sub-classes thereof, IgG1, IgG2, IgG3, IgG4, IgM, IgE, IgA, and IgD. In some embodiments, the antibody comprises a light chain variable domain and a heavy chain variable domain, e.g. in an scFv format.

Antibodies include variant polypeptide species that have one or more amino acid substitutions, insertions, or deletions in the native amino acid sequence, provided that the antibody retains or substantially retains its specific binding function. Conservative substitutions of amino acids are well known and described above.

The present disclosure further includes a method of producing an antibody, or antigen-binding fragment thereof, comprising a step of selecting antibodies that bind to a tumor neoantigen peptide as herein defined, optionally in association with an MHC or HLA molecule, with a Kd binding affinity of about $10^{-6}$ M or less, $10^{-7}$ M or less, $10^{-8}$ M or less, $10^{-9}$ M or less, $10^{-10}$ M or less, or $10^{-11}$ M or less.

In some embodiments, the antibodies are selected from a library of human antibody sequences. In some embodiments, the antibodies are generated by immunizing an animal with a polypeptide comprising the neoantigenic peptide, optionally in association with an MHC or HLA molecule, followed by the selection step.

Antibodies including chimeric, humanized or human antibodies can be further affinity matured and selected as described above. Humanized antibodies contain rodent-sequence derived CDR regions; typically the rodent CDRs are engrafted into a human framework, and some of the human framework residues may be back-mutated to the original rodent framework residue to preserve affinity, and/or one or a few of the CDR residues may be mutated to increase affinity. Fully human antibodies have no murine sequence, and are typically produced via phage display technologies of human antibody libraries, or immunization of transgenic mice whose native immunoglobin loci have been replaced with segments of human immunoglobulin loci.

Antibodies produced by said method, as well as immune cells expressing such antibodies or fragments thereof are also encompassed by the present disclosure.

The present disclosure also encompasses pharmaceutical compositions comprising one or more antibodies as herein disclosed alone or in combination with at least one other agent, such as a stabilizing compound, which may be administered in any sterile, biocompatible pharmaceutical carrier and optionally formulated with formulated with sterile pharmaceutically acceptable buffer(s), diluent(s), and/or excipient(s). Pharmaceutically acceptable carriers typically enhance or stabilize the composition, and/or can be used to facilitate preparation of the composition. Pharmaceutically acceptable carriers include solvents, dispersion media, coatings, antibacterial and antifungal agents, isotonic and absorption delaying agents, and the like that are physiologically compatible and in some embodiments pharmaceutically inert.

Administration of a pharmaceutical composition comprising antibodies as herein disclosed can be accomplished orally or parenterally. Methods of parenteral delivery include topical, intra-arterial (directly to the tumor), intramuscular, spinal, subcutaneous, intramedullary, intrathecal, intraventricular, intravenous, intraperitoneal, or intranasal administration.

Thus, in addition to the active ingredients, these pharmaceutical compositions may contain suitable pharmaceutically acceptable carriers comprising excipients and auxiliaries which facilitate processing of the active compounds into preparations which can be used pharmaceutically. Further details on techniques for formulation and administration may be found in the latest edition of Remington's Pharmaceutical Sciences (Ed. Maack Publishing Co, Easton, Pa.).

Depending on the route of administration, the active compound, i.e., antibody, bispecific and multispecific molecule, may be coated in a material to protect the compound from the action of acids and other natural conditions that may inactivate the compound.

The composition is typically sterile and preferably fluid. Proper fluidity can be maintained, for example, by use of coating such as lecithin, by maintenance of required particle size in the case of dispersion and by use of surfactants. In many cases, it is preferable to include isotonic agents, for example, sugars, polyalcohols such as mannitol or sorbitol, and sodium chloride in the composition. Long-term absorption of the injectable compositions can be brought about by including in the composition an agent which delays absorption, for example, aluminum monostearate or gelatin.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions and the like, for ingestion by the patient.

Pharmaceutical preparations for oral use can be obtained through combination of active compounds with solid excipient, optionally grinding a resulting mixture, and processing the mixture of granules, after adding suitable auxilliaries, if desired, to obtain tablets or dragee cores. Suitable excipients are carbohydrate or protein fillers such as sugars, including lactose, sucrose, mannitol, or sorbitol; starch from corn, wheat, rice, potato, or other plants; cellulose such as methyl, cellulose, hydroxypropylmethylcellulose, or sodium carboxymethylcellulose; and gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol and/or titanium dioxide, lacquer solutions, and suitable organic solvents or solvent mixtures. Dyestuffs or pigments may be added to the tablets or dragee coatings for product identification or to characterize the quantity of active compound, ie. dosage.

Pharmaceutical preparations that can be used orally include push-fit capsules made of gelatin, as well as soft, sealed capsules made of gelatin and a coating such as glycerol or sorbitol. Push-fit capsules can contain active ingredients mixed with a filler or binders such as lactose or starches, lubricants such as talc or magnesium stearate, and optionally, stabilizers. In soft capsules, the active compounds may be dissolved or suspended in suitable liquids, such as fatty oils, liquid paraffin, or liquid polyethylene glycol with or without stabilizers.

Pharmaceutical formulations for parenteral administration include aqueous solutions of active compounds. For injection, the pharmaceutical compositions of the invention may be formulated in aqueous solutions, preferably in physiologically compatible buffers such as Hank's solution, Ringer's solution, or physiologically buffered saline. Aqueous injection suspensions may contain substances that increase viscosity of the suspension, such as sodium carboxymethyl cellulose, sorbitol, or dextran. Additionally, suspensions of the active compounds may be prepared as appropriate oily injection suspensions. Suitable lipophilic solvents or vehicles include fatty oils such as sesame oil, or synthetic fatty acid esters, such as ethyl oleate or triglycerides, or liposomes. Optionally, the suspension may also contain suitable stabilizers or agents which increase the solubility of the compounds to allow for the preparation of highly concentrated solutions.

For topical or nasal administration, penetrants appropriate to the particular barrier to be permeated are used in the formulation. Such penetrants are generally known in the art.

Pharmaceutical compositions of the disclosure can be prepared in accordance with methods well known and routinely practiced in the art. See. e.g., Remington: The Science and Practice of Pharmacy, Mack Publishing Co., 20th ed., 2000; and Sustained and Controlled Release Drug Delivery Systems, J R. Robinson, ed., Marcel Dekker, Inc., New York, 1978. Pharmaceutical compositions are preferably manufactured under GMP conditions.

The present disclosure also encompasses a T cell receptor (TCR) that targets a neoantigenic peptide as herein defined in association with an MHC or HLA molecule.

The present disclosure further includes a method of producing a TCR, or an antigen-binding fragment thereof, comprising a step of selecting TCRs that bind to a tumor neoantigen peptide as herein defined, optionally in association with an MHC or HLA molecule, with a Kd binding affinity of about $10^{-6}$ M or less, $10^{-7}$ M or less, $10^{-8}$ M or less, $10^{-9}$ M or less, $10^{-10}$ M or less, or $10^{-11}$ M or less.

Nucleic acid encoding the TCR can be obtained from a variety of sources, such as by polymerase chain reaction (PCR) amplification of naturally occurring TCR DNA sequences, followed by expression of antibody variable regions, followed by the selecting step described above. In some embodiments, the TCR is obtained from T-cells isolated from a patient, or from cultured T-cell hybridomas. In some embodiments, the TCR clone for a target antigen has been generated in transgenic mice engineered with human immune system genes (e.g., the human leukocyte antigen system, or HLA). See, e.g., tumor antigens (see, e.g., Parkhurst et al. (2009) Clin Cancer Res. 15:169-180 and Cohen et al. (2005) J Immunol. 175:5799-5808. In some embodiments, phage display is used to isolate TCRs against a target antigen (see, e.g., Varela-Rohena et al. (2008) Nat Med. 14:1390-1395 and Li (2005) Nat Biotechnol. 23:349-354.

A "T cell receptor" or "TCR" refers to a molecule that contains a variable α and β chains (also known as TCRa and TCRb, respectively) or a variable γ and δ chains (also known as TCRg and TCRd, respectively) and that is capable of specifically binding to an antigen peptide bound to a MHC receptor. In some embodiments, the TCR is in the αβ form. Typically, TCRs that exist in αβ and γδ forms are generally structurally similar, but T cells expressing them may have distinct anatomical locations or functions. A TCR can be found on the surface of a cell or in soluble form. Generally, a TCR is found on the surface of T cells (or T lymphocytes) where it is generally responsible for recognizing antigens bound to major histocompatibility complex (MHC) molecules. In some embodiments, a TCR also can contain a constant domain, a transmembrane domain and/or a short cytoplasmic tail (see, e.g., Janeway et ah, Immunobiology: The Immune System in Health and Disease, 3 rd Ed., Current Biology Publications, p. 4:33, 1997). For example, in some aspects, each chain of the TCR can possess one N-terminal immunoglobulin variable domain, one immunoglobulin constant domain, a transmembrane region, and a short cytoplasmic tail at the C-terminal end. In some embodiments, a TCR is associated with invariant proteins of the CD3 complex involved in mediating signal transduction. Unless otherwise stated, the term "TCR" should be understood to encompass functional TCR fragments thereof. The term also encompasses intact or full-length TCRs, including TCRs in the αβ form or γδ form.

Thus, for purposes herein, reference to a TCR includes any TCR or functional fragment, such as an antigen-binding portion of a TCR that binds to a specific antigenic peptide bound in an MHC molecule, i.e. MHC-peptide complex. An "antigen-binding portion" or antigen-binding fragment" of a TCR, which can be used interchangeably, refers to a molecule that contains a portion of the structural domains of a TCR, but that binds the antigen (e.g. MHC-peptide complex) to which the full TCR binds. In some cases, an antigen-binding portion contains the variable domains of a TCR, such as variable a chain and variable β chain of a TCR, sufficient to form a binding site for binding to a specific MHC-peptide complex, such as generally where each chain contains three complementarity determining regions.

In some embodiments, the variable domains of the TCR chains associate to form loops, or complementarity determining regions (CDRs) analogous to immunoglobulins, which confer antigen recognition and determine peptide specificity by forming the binding site of the TCR molecule and determine peptide specificity. Typically, like immunoglobulins, the CDRs are separated by framework regions (FRs) {see, e.g., Jores et al., Pwc. Nat'l Acad. Sci. U.S.A. 87:9138, 1990; Chothia et al., EMBO J. 7:3745, 1988; see also Lefranc et al., Dev. Comp. Immunol. 27:55, 2003). In some embodiments, CDR3 is the main CDR responsible for recognizing processed antigen, although CDR1 of the alpha chain has also been shown to interact with the N-terminal part of the antigenic peptide, whereas CDR1 of the beta chain interacts with the C-terminal part of the peptide. CDR2 is thought to recognize the MHC molecule. In some embodiments, the variable region of the n-chain can contain a further hypervariability (HV4) region.

In some embodiments, the TCR chains contain a constant domain. For example, like immunoglobulins, the extracellular portion of TCR chains {e.g., α-chain, β-chain) can contain two immunoglobulin domains, a variable domain {e.g., Va or Vp; typically amino acids 1 to 116 based on Kabat numbering Kabat et al., "Sequences of Proteins of Immunological Interest, US Dept. Health and Human Services, Public Health Service National Institutes of Health, 1991, 5th ed.) at the N-terminus, and one constant domain {e.g., α-chain constant domain or Ca, typically amino acids 117 to 259 based on Kabat, β-chain constant domain or Cp, typically amino acids 117 to 295 based on Kabat) adjacent to the cell membrane. For example, in some cases, the extracellular portion of the TCR formed by the two chains contains two membrane-proximal constant domains, and two membrane-distal variable domains containing CDRs. The constant domain of the TCR domain contains short connecting sequences in which a cysteine residue forms a disulfide bond, making a link between the two chains. In some embodiments, a TCR may have an additional cysteine residue in each of the α and β chains such that the TCR contains two disulfide bonds in the constant domains.

In some embodiments, the TCR chains can contain a transmembrane domain. In some embodiments, the transmembrane domain is positively charged. In some cases, the TCR chains contain a cytoplasmic tail. In some cases, the structure allows the TCR to associate with other molecules like CD3. For example, a TCR containing constant domains with a transmembrane region can anchor the protein in the cell membrane and associate with invariant subunits of the CD3 signaling apparatus or complex.

Generally, CD3 is a multi-protein complex that can possess three distinct chains (γ, δ, and ε) in mammals and the ζ-chain. For example, in mammals the complex can contain a CD3y chain, a CD35 chain, two CD3s chains, and a homodimer of CD3ζ chains. The CD3y, CD35, and CD3s chains are highly related cell surface proteins of the immunoglobulin superfamily containing a single immunoglobulin domain. The transmembrane regions of the CD3y, CD35, and CD3s chains are negatively charged, which is a characteristic that allows these chains to associate with the positively charged T cell receptor chains. The intracellular tails of the CD3y, CD35, and CD3s chains each contain a single conserved motif known as an immunoreceptor tyrosine-based activation motif or ITAM, whereas each CD3ζ chain has three. Generally, ITAMs are involved in the signaling capacity of the TCR complex. These accessory molecules have negatively charged transmembrane regions and play a role in propagating the signal from the TCR into the cell. The CD3- and ζ-chains, together with the TCR, form what is known as the T cell receptor complex.

In some embodiments, the TCR may be a heterodimer of two chains α and β (or optionally γ and δ) or it may be a single chain TCR construct. In some embodiments, the TCR is a heterodimer containing two separate chains (α and β chains or γ and δ chains) that are linked, such as by a disulfide bond or disulfide bonds.

While T-cell receptors (TCRs) are transmembrane proteins and do not naturally exist in soluble form, antibodies can be secreted as well as membrane bound. Importantly, TCRs have the advantage over antibodies that they in principle can recognize peptides generated from all degraded cellular proteins, both intra- and extracellular, when presented in the context of MHC molecules. Thus TCRs have important therapeutic potential.

The present disclosure also relates to soluble T-cell receptors (sTCRs) that contain the antigen recognition part directed against a tumor neoantigenic peptide as herein disclosed (see notably Walseng E, Wälchli S, Fallang L-E, Yang W, Vefferstad A, Areffard A, et al. (2015) Soluble T-Cell Receptors Produced in Human Cells for Targeted Delivery. PLoS ONE 10(4): e0119559). In a particular embodiment, the soluble TCR can be fused to an antibody fragment directed to a T cell antigen, optionally wherein the targeted antigen is CD3 or CD16 (see for example Boudousquie, Caroline et al. "Polyfunctional response by ImmTAC (IMCgp100) redirected CD8+ and CD4+ T cells." Immunology vol. 152, 3 (2017): 425-438. doi:10.1111/imm.12779).

The present disclosure also encompasses a chimeric antigen receptor (CAR) which is directed against a tumor neoantigenic peptide as herein disclosed. CARs are fusion proteins comprising an antigen-binding domain, typically derived from an antibody, linked to the signalling domain of the TCR complex. CARs can be used to direct immune cells such T-cells or NK cells against a tumor neoantigenic peptide as previously defined with a suitable antigen-binding domain selected.

The antigen-binding domain of a CAR is typically based on a scFv (single chain variable fragment) derived from an antibody. In addition to an N-terminal, extracellular antibody-binding domain, CARs typically may comprise a hinge domain, which functions as a spacer to extend the antigen-binding domain away from the plasma membrane of the immune effector cell on which it is expressed, a trans-membrane (TM) domain, an intracellular signalling domain (e.g. the signalling domain from the zeta chain of the CD3 molecule (CD3ζ) of the TCR complex, or an equivalent) and optionally one or more co-stimulatory domains which may assist in signalling or functionality of the cell expressing the CAR. Signalling domains from co-stimulatory molecules including CD28, OX-40 (CD134), and 4-1BB (CD137) can be added alone (second generation) or in combination (third generation) to enhance survival and increase proliferation of CAR modified T cells. Potential co-stimulatory domains also include ICOS-1, CD27, GITR, and DAP10.

Thus, the CAR may include (1) In its extracellular portion, one or more antigen binding molecules, such as one or more antigen-binding fragment, domain, or portion of an antibody, or one or more antibody variable domains, and/or antibody molecules.

(2) In its transmembrane portion, a transmembrane domain derived from human T cell receptor-alpha or -beta chain, a CD3 zeta chain, CD28, CD3-epsilon, CD45, CD4, CD5, CD8, CD9, CD16, CD22, CD33, CD37, CD64, CD80, CD86, CD134, CD137, ICOS, CD154, or a GITR. In some embodiments, the transmembrane domain is derived from CD28, CD8 or CD3-zeta.

(3) One or more co-stimulatory domains, such as co-stimulatory domains derived from human CD28, 4-1BB (CD137), ICOS-1, CD27, OX 40 (CD137), DAP10, and GITR (AITR). In some embodiments, the CAR comprises co-stimulating domains of both CD28 and 4-1BB.

(4) In its intracellular signalling domain, an intracellular signalling domain comprising one or more ITAMs, for example, the intracellular signalling domain is CD3- zeta, or a variant thereof lacking one or two ITAMs (e.g. ITAM3 and ITAM2), or the intracellular signalling domain is derived from FcεRIγ.

The CAR can be designed to recognize tumor neoantigenic peptide alone or in association with an HLA or MHC molecule.

Exemplary antigen receptors, including CARs and recombinant TCRs, as well as methods for engineering and introducing the receptors into cells, include those described, for example, in international patent application publication numbers WO200014257, WO2013126726, WO2012/129514, WO2014031687, WO2013/166321, WO2013/071154, WO2013/123061 U.S. patent application publication numbers US2002131960, US2013287748, US20130149337, U.S. Pat. Nos. 6,451,995, 7,446,190, 8,252,592, 8,339,645, 8,398,282, 7,446,179, 6,410,319, 7,070,995, 7,265,209, 7,354,762, 7,446,191, 8,324,353, and 8,479,118, and European patent application number EP2537416, and/or those described by Sadelain et al., Cancer Discov. 2013 April; 3(4): 388-398; Davila et al. (2013) PLoS ONE 8(4): e61338; Turtle et al., Curr. Opin. Immunol., 2012 October; 24(5): 633-39; Wu et al., Cancer, 2012 March 18(2): 160-75. In some aspects, the genetically engineered antigen receptors include a CAR as described in U.S. Pat. No. 7,446,190, and those described in International Patent Application Publication No.: WO/2014055668 A1.

The present disclosure also encompasses polynucleotides encoding antibodies, antigen-binding fragments or derivatives thereof, TCRs and CARs as previously described as well as vector comprising said polynucleotide(s).

Immune Cells

The present disclosure further encompasses immune cells which target one or more tumor neoantigenic peptides as previously described.

As used herein, the term "immune cell" includes cells that are of hematopoietic origin and that play a role in the immune response. Immune cells include lymphocytes, such as B cells and T cells, natural killer cells, myeloid cells, such as monocytes, macrophages, eosinophils, mast cells, basophils, and granulocytes.

As used herein, the term "T cell" includes cells bearing a T cell receptor (TCR), in particular TCR directed against a tumor neoantigenic peptide as herein disclosed. T-cells according to the present disclosure can be selected from the group consisting of inflammatory T-lymphocytes, cytotoxic T-lymphocytes, regulatory T-lymphocytes, Mucosal-Associated Invariant T cells (MAIT), Yδ T cell, tumour infiltrating lymphocyte (TILs) or helper T-lymphocytes included both type 1 and 2 helper T cells and Th17 helper cells. In another embodiment, said cell can be derived from the group consisting of CD4+T-lymphocytes and CD8+T-lymphocytes. Said immune cells may originate from a healthy donor or from a subject suffering from a cancer.

Immune cells can be extracted from blood or derived from stem cells. The stem cells can be adult stem cells, embryonic stem cells, more particularly non-human stem cells, cord blood stem cells, progenitor cells, bone marrow stem cells, induced pluripotent stem cells, totipotent stem cells or hematopoietic stem cells. Representative human cells are CD34+ cells.

T-cells can be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In certain embodiments, T-cells can be obtained from a unit of blood collected from a subject using any number of techniques known to the skilled person, such as FICOLL™ separation. In one embodiment, cells from the circulating blood of a subject are obtained by apheresis. In certain embodiments, T-cells are isolated from PBMCs. PBMCs may be isolated from buffy coats obtained by density gradient centrifugation of whole blood, for instance centrifugation through a LYMPHOPREP™ gradient, a PER-COLL™ gradient or a FICOLL™ gradient. T-cells may be isolated from PBMCs by depletion of the monocytes, for instance by using CD14 DYNABEADS®. In some embodiments, red blood cells may be lysed prior to the density gradient centrifugation.

In another embodiment, said cell can be derived from a healthy donor, from a subject diagnosed with cancer. The cell can be autologous or allogeneic.

In allogeneic immune cell therapy, immune cells are collected from healthy donors, rather than the patient. Typically these are HLA matched to reduce the likelihood of graft vs. host disease. Alternatively, universal 'off the shelf' products that may not require HLA matching comprise modifications designed to reduce graft vs. host disease, such as disruption or removal of the TCRαβ receptor. See Graham et al., Cells. 2018 October; 7(10): 155 for a review. Because a single gene encodes the alpha chain (TRAC) rather than the two genes encoding the beta chain, the TRAC locus is a typical target for removing or disrupting TCRαβ receptor expression. Alternatively, inhibitors of TCRαβ signalling may be expressed, e.g. truncated forms of CD3ζ can act as a TCR inhibitory molecule. Disruption or removal of HLA class I molecules has also been employed. For example, Torikai et al., Blood. 2013; 122:1341-1349 used ZFNs to knock out the HLA-A locus, while Ren et al., Clin. Cancer Res. 2017; 23:2255-2266 knocked out Beta-2 microglobulin (B2M), which is required for HLA class I expression. Ren et al. simultaneously knocked out TCRαβ, B2M and the immune-checkpoint PD1. Generally, the immune cells are activated and expanded to be utilized in the adoptive cell therapy. The immune cells as herein disclosed can be expanded in vivo or ex vivo. The immune cells, in particular T-cells can be activated and expanded generally using methods known in the art. Generally the T-cells are expanded by contact with a surface having attached thereto an agent that stimulates a CD3/TCR complex associated signal and a ligand that stimulates a co-stimulatory molecule on the surface of the T cells.

In one embodiment of the present disclosure, the immune cell can be modified to be directed to tumor neoantigenic peptides as previously defined. In a particular embodiment, said immune cell may express a recombinant antigen receptor directed to said neoantigenic peptide its cell surface. By "recombinant" is meant an antigen receptor which is not encoded by the cell in its native state, i.e. it is heterologous, non-endogenous. Expression of the recombinant antigen receptor can thus be seen to introduce new antigen specificity to the immune cell, causing the cell to recognise and bind a previously described peptide. The antigen receptor may be isolated from any useful source. In some embodiments, the cells comprise one or more nucleic acids introduced via genetic engineering that encode one or more antigen receptors, wherein the antigen include at least one tumor neoantigenic peptide as per the present disclosure.

Among the antigen receptors as per the present disclosure are genetically engineered T cell receptors (TCRs) and components thereof, as well as functional non-TCR antigen receptors, such as chimeric antigen receptors (CAR) as previously described.

Methods by which immune cells can be genetically modified to express a recombinant antigen receptor are well known in the art. A nucleic acid molecule encoding the antigen receptor may be introduced into the cell in the form of e.g. a vector, or any other suitable nucleic acid construct. Vectors, and their required components, are well known in the art. Nucleic acid molecules encoding antigen receptors can be generated using any method known in the art, e.g. molecular cloning using PCR. Antigen receptor sequences can be modified using commonly-used methods, such as site-directed mutagenesis.

The present disclosure also relates to a method for providing a T cell population which targets a tumor neoantigenic peptide as herein disclosed.

The T cell population may comprise CD8+ T cells, CD4+ T cells or CD8+ and CD4+ T cells.

T cell populations produced in accordance with the present disclosure may be enriched with T cells that are specific to, i.e. target, the tumor neoantigenic peptide of the present disclosure. That is, the T cell population that is produced in accordance with the present disclosure will have an increased number of T cells that target one or more tumor neoantigenic peptide. For example, the T cell population of the disclosure will have an increased number of T cells that target a tumor neoantigenic peptide compared with the T cells in the sample isolated from the subject. That is to say, the composition of the T cell population will differ from that of a "native" T cell population (i.e. a population that has not undergone the identification and expansion steps discussed herein), in that the percentage or proportion of T cells that target a tumor neoantigenic peptide will be increased.

T cell populations produced in accordance with the present disclosure may be enriched with T cells that are specific to, i.e. target, tumor neoantigenic peptide. That is, the T cell population that is produced in accordance with the present disclosure will have an increased number of T cells that target one or more tumor neoantigenic peptide of the present disclosure. For example, the T cell population of the present disclosure will have an increased number of T cells that target a tumor neoantigenic peptide compared with the T cells in the sample isolated from the subject. That is to say, the composition of the T cell population will differ from that of a "native" T cell population (i.e. a population that has not undergone the identification and expansion steps discussed herein), in that the percentage or proportion of T cells that target a tumor neoantigenic peptide will be increased.

The T cell population according to the present disclosure may have at least about 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95 or 100% T cells that target a tumor neoantigenic peptide as herein disclosed. For example, the T cell population may have about 0.2%-5%, 5%-10%, 10-20%, 20-30%, 30-40%, 40-50%, 50-70% or 70-100% T cells that target a tumor neoantigenic peptide of the present disclosure.

An expanded population of tumor neoantigenic peptide-reactive T cells may have a higher activity than a population of T cells not expanded, for example, using a tumor neoantigenic peptide. Reference to "activity" may represent the response of the T cell population to restimulation with a tumor neoantigenic peptide, e.g. a peptide corresponding to the peptide used for expansion, or a mix of tumor neoantigenic peptide. Suitable methods for assaying the response are known in the art. For example, cytokine production may be measured (e.g. IL2 or IFNy production may be measured). The reference to a "higher activity" includes, for example, a 1-5, 5-10, 10-20, 20-50, 50-100, 100-500, 500-1000-fold increase in activity. In one aspect the activity may be more than 1000-fold higher.

In a preferred embodiment present disclosure provides a plurality or population, i.e. more than one, of T cells wherein the plurality of T cells comprises a T cell which recognizes a clonal tumor neoantigenic peptide and a T cell which recognizes a different clonal tumor neoantigenic peptide. As such, the present disclosure provides a plurality of T cells which recognize different clonal tumor neoantigenic peptide. Different T cells in the plurality or population may alternatively have different TCRs which recognize the same tumor neoantigenic peptide.

In a preferred embodiment the number of clonal tumor neoantigenic peptide recognized by the plurality of T cells is from 2 to 1000. For example, the number of clonal neoantigens recognized may be 2, 3, 4, 5, 6, 7, 8, 9, 10, 20, 50, 100, 150, 200, 250, 300, 350, 400, 450, 500, 550, 600, 650, 700, 750, 800, 850, 900, 950 or 1000, preferably 2 to 100. There may be a plurality of T cells with different TCRs but which recognize the same clonal neo-antigen.

The T cell population may be all or primarily composed of CD8+ T cells, or all or primarily composed of a mixture of CD8+ T cells and CD4+ T cells or all or primarily composed of CD4+ T cells.

In particular embodiments, the T cell population is generated from T cells isolated from a subject with a tumor. For example, the T cell population may be generated from T cells in a sample isolated from a subject with a tumor. The sample may be a tumor sample, a peripheral blood sample or a sample from other tissues of the subject.

In a particular embodiment the T cell population is generated from a sample from the tumor in which the tumor neoantigenic peptide is identified. In other words, the T cell population is isolated from a sample derived from the tumor of a patient to be treated. Such T cells are referred to herein as 'tumor infiltrating lymphocytes' (TILs).

T cells may be isolated using methods which are well known in the art. For example, T cells may be purified from single cell suspensions generated from samples on the basis of expression of CD3, CD4 or CD8. T cells may be enriched from samples by passage through a Ficoll-plaque gradient.

Cancer Therapeutic Methods

In any of the embodiments, the Cancer Therapeutic Products described herein may be used in methods for inhibiting proliferation of cancer cells. The Cancer Therapeutic Products described herein may also be used in the treatment of cancer, in patients suffering from cancer, or for the prophylactic treatment of cancer, in patients at risk of cancer.

Cancers that can be treated using the therapy described herein include any solid or non-solid tumors as previously defined. Of particular interest according to the present disclosure are breast cancer, melanoma and lung cancer. In a specific embodiment of the present disclosure, the cancer is non-small cell lung cancer (NSCLC).

Cancers includes also the cancers which are refractory to treatment with other chemotherapeutics. The term "refractory, as used herein refers to a cancer (and/or metastases thereof), which shows no or only weak antiproliferative response (e.g., no or only weak inhibition of tumor growth) after treatment with another chemotherapeutic agent. These are cancers that cannot be treated satisfactorily with other chemotherapeutics. Refractory cancers encompass not only (i) cancers where one or more chemotherapeutics have already failed during treatment of a patient, but also (ii) cancers that can be shown to be refractory by other means, e.g., biopsy and culture in the presence of chemotherapeutics.

The therapy described herein is also applicable to the treatment of patients in need thereof who have not been previously treated.

A subject as per the present disclosure is typically a patient in need thereof that has been diagnosed with cancer or is at risk of developing cancer. The subject is typically a human, dog, cat, horse or any animal in which a tumor specific immune response is desired.

The present disclosure also pertains to a neoantigenic peptide, a population of APCs, a vaccine or immunogenic composition, a polynucleotide encoding a neoantigenic peptide or a vector as previously defined for use in cancer vaccination therapy of a subject or for treating cancer in a subject, wherein the peptide(s) binds at least one MHC molecule of said subject.

The present disclosure also provides a method for treating cancer in a subject comprising administering a vaccine or immunogenic composition as described herein to said subject in a therapeutically effective amount to treat the subject. The method may additionally comprise the step of identifying a subject who has cancer.

The present disclosure also relates to a method of treating cancer comprising producing an antibody or antigen-binding fragment thereof by the method as herein described and administering to a subject with cancer said antibody or antigen-binding fragment thereof, or with an immune cell expressing said antibody or antigen-binding fragment thereof, in a therapeutically effective amount to treat said subject.

The present disclosure also relates to an antibody (including variants and derivatives thereof), a T cell receptor (TCR) (including variants and derivatives thereof), or a CAR (including variants and derivatives thereof) which are directed against a tumor neoantigenic peptide as herein described, optionally in association with an MHC or HLA molecule, for use in cancer therapy of a subject, wherein the tumor neoantigenic peptide binds at least one MHC molecule of said subject.

The present disclosure also relates to an antibody (including variants and derivatives thereof), a T cell receptor (TCR) (including variants and derivatives thereof), or a CAR (including variants and derivatives thereof) which are directed against a tumor neoantigenic peptide as herein described, optionally in association with an MHC or HLA molecule, or an immune cell which targets a neoantigenic peptide, as previously defined, for use in adoptive cell or CAR-T cell therapy in a subject, wherein the tumor neoantigenic peptide binds at least one MHC molecule of said subject.

Typically, the skilled person is able to select an appropriate antigen receptor which binds and recognizes a tumor neoantigenic peptide as previously defined with which to redirect an immune cell to be used for use in cancer cell therapy. In a particular embodiment, the immune cell for use in the method of the present disclosure is a redirected T-cell, e.g. a redirected CD8+ and/or CD4+ T-cell.

In some embodiments, cancer treatment, vaccination therapy and/or adoptive cell cancer therapy as above described are administered in combination with additional cancer therapies. In particular, the T cell compositions according to the present disclosure may be administered in combination with checkpoint blockade therapy, co-stimulatory antibodies, chemotherapy and/or radiotherapy, targeted therapy or monoclonal antibody therapy.

Checkpoint inhibitors include, but are not limited to, PD-1 inhibitors, PD-L1 inhibitors, Lag-3 inhibitors, Tim-3 inhibitors, TIGIT inhibitors, BTLA inhibitors, V-domain Ig suppressor of T-cell activation (VISTA) inhibitors and CTLA-4 inhibitors, IDO inhibitors for example. Co-stimulatory antibodies deliver positive signals through immune-regulatory receptors including but not limited to ICOS, CD137, CD27 OX-40 and GITR. In a preferred embodiment the checkpoint inhibitor is a CTLA-4 inhibitor.

A chemotherapeutic entity as used herein refers to an entity which is destructive to a cell, that is the entity reduces the viability of the cell. The chemotherapeutic entity may be a cytotoxic drug. A chemotherapeutic agent contemplated includes, without limitation, alkylating agents, anthracyclines, epothilones, nitrosoureas, ethylenimines/methylmelamine, alkyl sulfonates, alkylating agents, antimetabolites, pyrimidine analogs, epipodophylotoxins, enzymes such as L-asparaginase; biological response modifiers such as IFNa, IL-2, G-CSF and GM-CSF; platinum coordination complexes such as cisplatin, oxaliplatin and carboplatin, anthracenediones, substituted urea such as hydroxyurea, methylhydrazine derivatives including N-methylhydrazine (MIH) and procarbazine, adrenocortical suppressants such as mitotane (o,p'-DDD) and aminoglutethimide; hormones and antagonists including adrenocorticosteroid antagonists such as prednisone and equivalents, dexamethasone and aminoglutethimide; progestin such as hydroxyprogesterone caproate, medroxyprogesterone acetate and megestrol acetate; estrogen such as diethylstilbestrol and ethinyl estradiol equivalents; antiestrogen such as tamoxifen; androgens including testosterone propionate and fluoxymesterone/equivalents; antiandrogens such as flutamide, gonadotropin-releasing hormone analogs and leuprolide; and non-steroidal antiandrogens such as flutamide. 'In combination' may refer to administration of the additional therapy before, at the same time as or after administration of the T cell composition according to the present disclosure.

In addition or as an alternative to the combination with checkpoint blockade, the T cell composition of the present disclosure may also be genetically modified to render them resistant to immune-checkpoints using gene-editing technologies including but not limited to TALEN and Crispr/Cas. Such methods are known in the art, see e.g. US20140120622. Gene editing technologies may be used to prevent the expression of immune checkpoints expressed by T cells including but not limited to PD-1, Lag-3, Tim-3, TIGIT, BTLA CTLA-4 and combinations of these. The T cell as discussed here may be modified by any of these methods.

The T cell according to the present disclosure may also be genetically modified to express molecules increasing homing into tumours and or to deliver inflammatory mediators into the tumour microenvironment, including but not limited to cytokines, soluble immune-regulatory receptors and/or ligands.

In a particular embodiment, said tumor neoantigenic peptide is used in cancer vaccination therapy in combination with another immunotherapy such as immune checkpoint therapy, more particularly in combination with antibodies anti-PD1, anti-PDL1, anti-CTLA-4, anti-TIM-3, anti-LAG3, anti-GITR.

BRIEF DESCRIPTION OF THE DRAWINGS

FIG. 9: Reconstruction of the fusion nucleotide sequence when the donor is the exon (A) and when the donor is the TE (B).

EXAMPLES

Figure 1A:
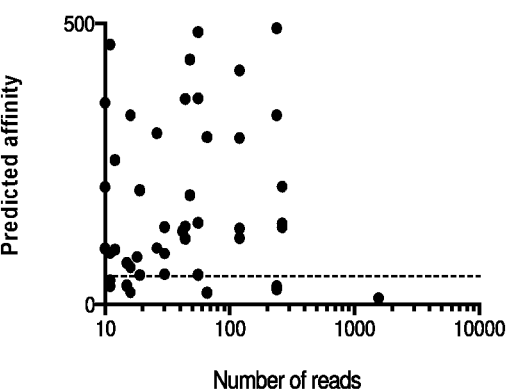
FIG. 1: Tumor neoantigenic peptides (or TE-derived epitopes) having a predicted affinity for MHC alleles of less than 500 nM, identified by the in silico method according to the disclosure in the tumor mouse lines B16F10-OVA cells (A) and in MCA101-OVA cells (B) and identified both in the two lines (C).

1. Example 1: Identification of Fusion Transcript Sequence Encoded Tumor Neoantigenic Peptide

1.1 Proof of Concept in Mice

To detect individual and shared tumor neoantigenic peptide issued from fusion transcripts sequences, a bioinformatics pipeline has been developed. This pipeline is designed to identify tumor-specific mRNA sequences composed in part of a TE sequence and in part of an exonic sequence. This pipeline implies determining the MHC alleles. For each human sample, the Class I and Class II MHC alleles can be determined using the seq2hla (v2.2) tool (bitbucket.org/ sebastian_boegel/seq2hla). For mouse models, murine H-2 alleles are generally known. The bioinformatics method comprises the mapping of transcripts from RNA-sequencing against the reference genome. For the proof of concept analyses described here, mm10 was used for mouse and hg19 for human. Different versions of assembled genomes can be used for example hg19, hg38, mm9 or mm10. This mapping is carried out with STAR (v2.5.3a) (github.com/ alexdobin/STAR), with the following setting:

For allowing multi-hits mapping the parameter outFilterMultimapNmax which sets the maximum number of loci, the read is allowed to map to, is set at 1000, and For detecting the abnormal junction (fusion), the parameter chimSegmentMin which sets the minimum length of fusion segment, is set at 10, the parameter chimJunctionOverhangMin which sets the minimum overhang for a fusion junction is set at 10.

Normal (from SJ.out.tab output file) and abnormal (from Chimeric.out.junction output file) junctions are annotated using Ensembl and repeatmasker databases. Normal junctions define all the junctions that match the parameters used for the mapping (maximum intron length <=1 000 000 bp (set by —alignIntronMax), same chromosome and well oriented) and abnormal ones are junctions that do not match with at least one of the previous criteria. This mean that a TE/Exon junction could be in both junction type but a Exon/Exon junction must be in normal file (SJ.out.tab). Transcript sequences comprising a junction between a TE sequence and an exonic sequence are extracted in silico. From the area of the transcript sequence which overlaps the junction, or downstream of the junction when out-of-frame (reading frame non-canonical), the software predicts, in all reading frames, all possible peptides of 8 or 9 mers. Then, the binding affinity of all these possible peptides for the MHC alleles previously defined for the matched sample is determined netMHCpan (v3.4) (cbs.dtu.dk/services/ NetMHCpan/). There are currently more than a dozen various prediction algorithms for predicting the binding affinity of peptides, with NetMHC being the most widely used and validated algorithm for neoantigen prediction pipelines.

Peptides with either less than 500 nM or with a percentile rank less than 2% are considered as potential neo-antigens. Each splice site (donor or acceptor) is uniquely annotated as TE or as Exon. The part in the 5' end is qualified "donor", and the part in the 3' is qualified "acceptor".

Predicted HLA-binding peptides shared between cancer and normal tissues are excluded from further analyses.

This method has been applied to RNAseq data obtained from 7 well-characterized murine tumor cell lines (B16F10, B16F10-OVA, MCA101, MCA101-OVA, MC38, MC38-GFP, MC38-GFP-OVA). The cell lines with the extension-OVA corresponding to the same model but further expressing ovalbumin. In this study, this line is considered as the similar model, that is to say for example that an assay carried out on the cell line from B16F10-OVA is considered as a repeat of an assay carried out on the cell line from B16F10.

Figure 1B:
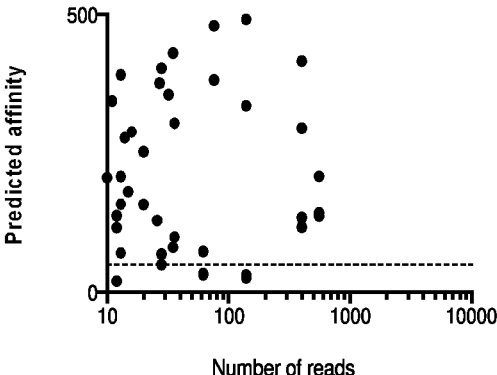
Figure 1C:
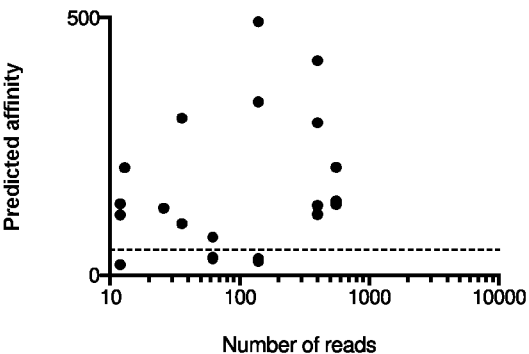

A list of candidate peptides has been obtained with these parameters (FIGS. 1A, 1B and 1C), some were specific to particular cell lines (FIGS. 1A and 1B), and some were shared between the two tumor cell lines (FIG. 1C).

For validation, we selected a range of peptides, expressed either in B16F10-OVA or MCA101-OVA, with predicted affinities less than 500 nM. Peptides were selected trying to optimize the ratio between number of reads and predicted affinity for MHC-I.

Four predicted tumor neoantigenic peptides were selected and characterized by identifying the TE and the exonic sequence (table 3).

TABLE 2

| Characterization of 4 predicted tumor neoantigenic peptides selected by the method | | | | |
|---|---|---|---|---|
| Peptide | Cell line | Donor | Acceptor | Predicted affinity |
| N25 | B16/B16-OVA | ERV-MaLR (subfamily MTA) | Chmp3, exon2 | H2-Db, 51.8937 |
| N26 | MCA/MCA-OVA MC38-GFP/MC38-OVAGFP | SINE-Alu(B1F) | Angel2, exon2 | H2-Kb, 392.0384 |
| N90 | MCA/MCA-OVA | Predicted gene 45873 | ERVL-MaLR (subfamily ORR1A2-int) | H2-Kb, 403.8959 and 50.5416 |
| N94 | MCA/MCA-OVA MC38-GFP/MC38-OVAGFP | Rsrc1 | ERV1 (subfamily RLTR4_MM-int) | H2-Kb, 431.0564 |

1.2 Validation by RT-PCR of the Fusion Transcript Sequence

First, a validation by regular RT-PCR has been performed, using primer pairs with one primer in the TE sequence, and the other one in the exonic sequence.

For the RNA extraction and reverse transcription, $3\text{-}5\cdot10^6$ cells were lyzed in 500 µL Trizol, and 100 µL phenol-chloroform added to the lyzates prior centrifugation. Aqueous phase was collected, mixed in a 1:1 ratio with 100% EtOH and transferred to RNAeasy minikit columns. RNA was then collected following manufacturer's instructions (including on column DNAse treatment). After RNA elution, DNA contaminants were further removed by treatment with Turbo DNAse (Fisher scientific), according to manufacturer's instructions). RNA concentration was measured using a nanodrop, and 1 µg of RNA used for reverse transcription. First strand synthesis was performed with Superscript III (Life technologies) using oligodT(15) as primers, according to manufacturer's instructions. Primers were ordered from Eurogentec. PCR reactions were performed using Taq polymerase. After identification of optimal conditions for each reaction, PCR products were extracted from agarose gels, and sequencing was performed using GATC lightrun. Sequence alignment was checked with APE software.

Figure 2A:
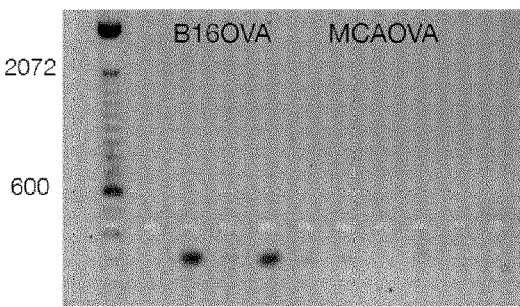
FIG. 2: (A) RT-PCR gels of amplification of the fusion transcript sequence encoding the neoantigenic peptide N25, in cDNA of tumor mouse lines B16F10-OVA and MCA101-OVA. (B) RT-PCR gels of amplification of the fusion transcript sequence encoding the neoantigenic peptide N26, in cDNA of tumor mouse lines B16F10, B16F10-OVA and MCA101-OVA.
Figure 2B:
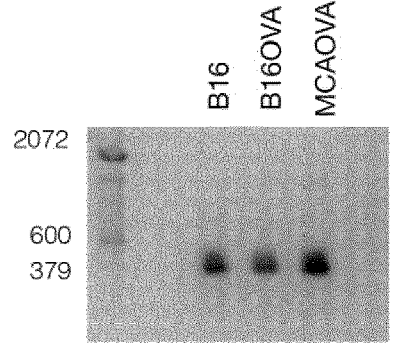

Using this approach, bands matching predicted size for N25, N26, N90 and N94 were detected, respectively in the cell lines identified in Table 1 (See FIG. 2A for N25). Interestingly, although N26 was detected only in MCA and MC38 cells in silico by RNAseq as previously described in the pipeline, using RT-PCR we detected a band corresponding to N26 in B16F10-OVA cells (FIG. 2B), indicating that this sequence is shared between three independent tumor cell lines (MCA, MC38 and B16F10). By re-analyzing the RNAseq data, we found that the N26 junction was present in B16F10-OVA cells, but below the detection threshold of the algorithm. Moreover, sequencing of the RT-PCR product showed exact match with sequences predicted by the algorithm.

1.3 In Vivo Immunization of Mice

Figure 3A:
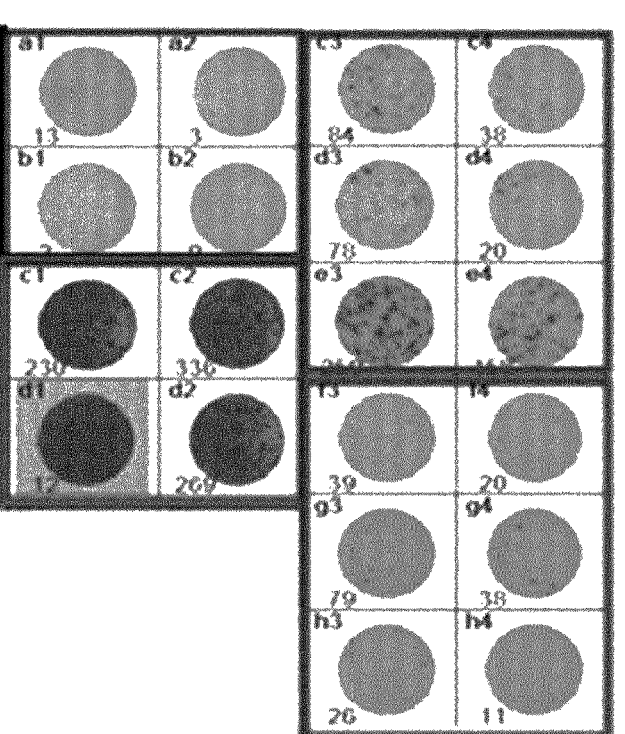
FIG. 3: (A) Detection of peptide-reactive IFNg-secreting cells by ELISPOT in inguinal lymph nodes from immunized animals with DMSO (negative control), OVA (ovalbumine) (positive control), peptide N25 or peptide N26. (B) IFNg spots for 10≡cells for immunized animals with DMSO (negative control), SIINFEKL (positive control), N25 or N26 peptide.
Figure 3B:
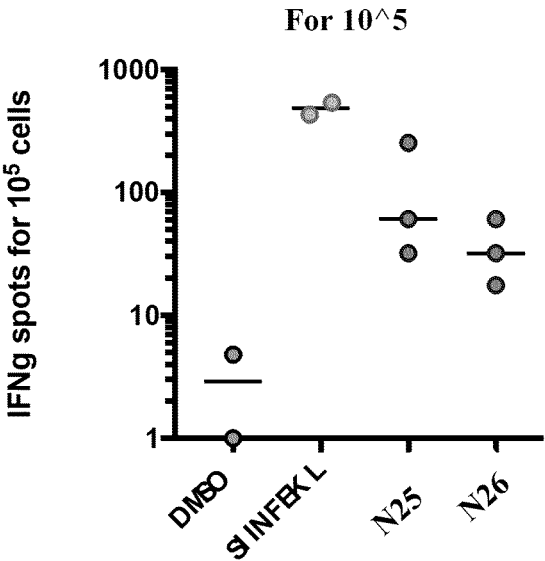

To validate these candidates in vivo, short (9-mers) peptides corresponding to neoantigenic peptide which binds to the MHC class I sequences, were synthetized. For the in vivo assays, long (27-mers) peptides, which include the flanking regions to the predicted MHC-binding short peptides of 9 mers, were synthetized, because this length is better suited for in vivo immunization. B16F10 OVA and MCA101-OVA were maintained in RPMI, Glutamax, 10% FCS, 1% penicillin-streptomycin and passaged using TrypLE. Cells were kept in culture for a maximum of one month, and new vials were thawed for each in vivo experiment. C57BL6J recipient mice were immunized with 100 µg long peptide (N25L or N26L), SIINFEKL peptide (short OVA peptide), OVA (Sigma) or DMSO, each with 50 µg polyL:C, by subcutaneous injection into the flank. Immunizations were repeated 7 days after primary immunization. 3 days later (10 days after primary immunization), animals were sacrificed and numbers of peptide-specific IFNg-secreting CD8 T cells in inguinal lymph nodes were detected by ELISPOT (FIG. 3A). Short peptides (N25, N26, or SIINFEKL) or DMSO at $10\ \mu g\cdot mL^{-1}$ were used to restimulate T cells. Alternatively, 7 days after secondary immunization, animals were injected subcutaneously with $2.5\cdot10^5$ B16F10-OVA or $5\cdot10^5$ MCA-OVA cells in PBS. We found that N25, and to a lesser extent N26 were able to induce immune responses (FIG. 3B).

1.4 In Vivo Treatment of Mice with Tumor

To test whether these peptides were protective against tumor cells, we immunized C57BL6 mice with 100 mg peptides N25L or N26L, or OVA (control peptide) and 50 µg polyL:C in PBS at d0 and d7, and at d14, we injected $2.5\cdot10^5$ B16F10-OVA cells to mice immunized with OVA, N25L and N26L. B16F10 OVA and MCA101-OVA were maintained in RPMI, Glutamax, 10% FCS, 1% penicillin-streptomycin and passaged using TrypLE. Cells were kept in culture for a maximum of one month, and new vials were thawed for each in vivo experiment. C57BL6J recipient mice were immunized with 100 µg long peptide (N25L or N26L), OVA (Sigma) or DMSO, each with 50 µg polyL:C, by subcutaneous injection into the flank. Immunizations were repeated 7 days after primary immunization.

Figure 4A:
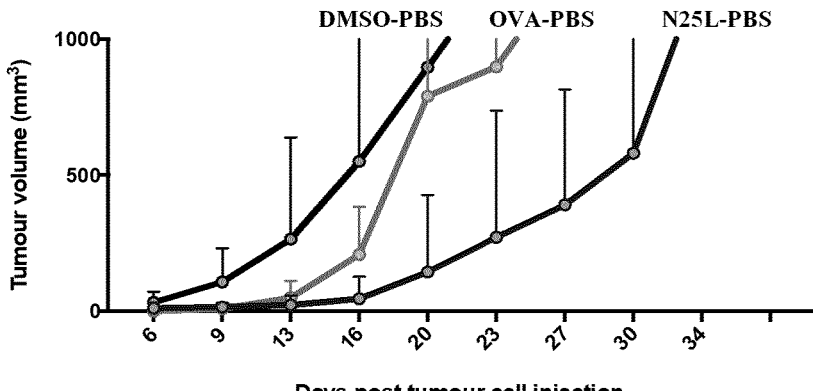
FIG. 4: (A) Evolution of the tumor volume (mm3) in mice beforehand immunized with DMSO, OVA or N25L peptide, following the days after the injection of tumor cells B16F10-OVA into said immunized mice. (B) Evolution of the tumor volume (mm3) in mice beforehand immunized with DMSO, OVA or N26L peptide, following the days after the injection of tumor cells B16F10-OVA into said immunized mice.
Figure 4B:
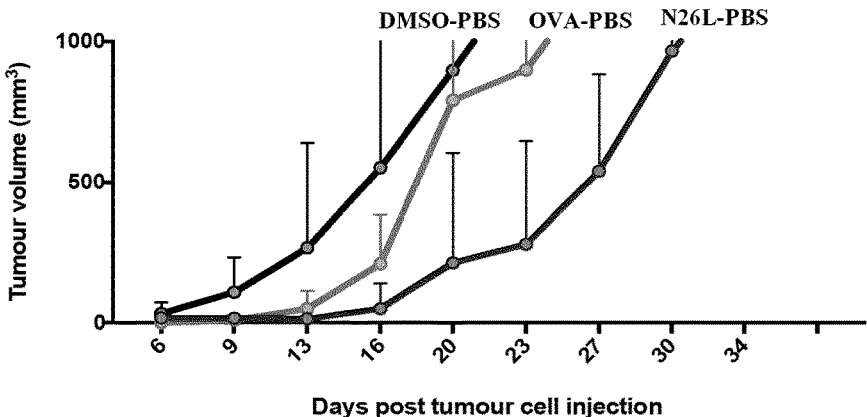
Figure 5A:
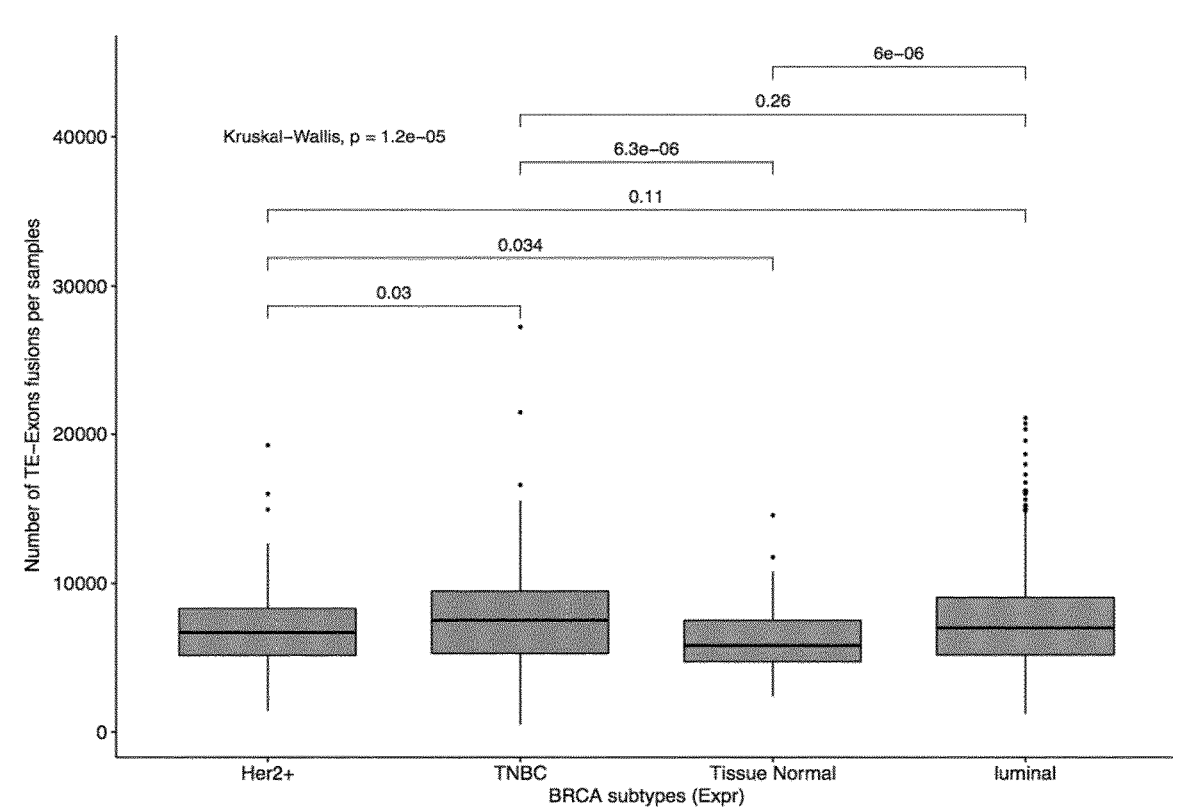
FIG. 5: TCGA data sets for 784 luminal, 100 HER2+, 197 TNBC, 112 normal breast tissue, 516 primary lung adenocarcinomas (primary tumor) and 59 normal lung tissue (solid tissue normal), were analyzed by the method for identifying fusion transcript sequence encoded tumor neoantigenic peptide described. (A) Number of fusion transcript sequence (TE-exon fusions) in different subtypes of breast cancer (HER2+, TNBC, normal breast tissue and luminal). (B) Number of fusion transcript sequence (TE-exon fusions) in different subtypes of lung cancer (primary lung adenocarcinomas, normal lung tissue).
Figure 5B:
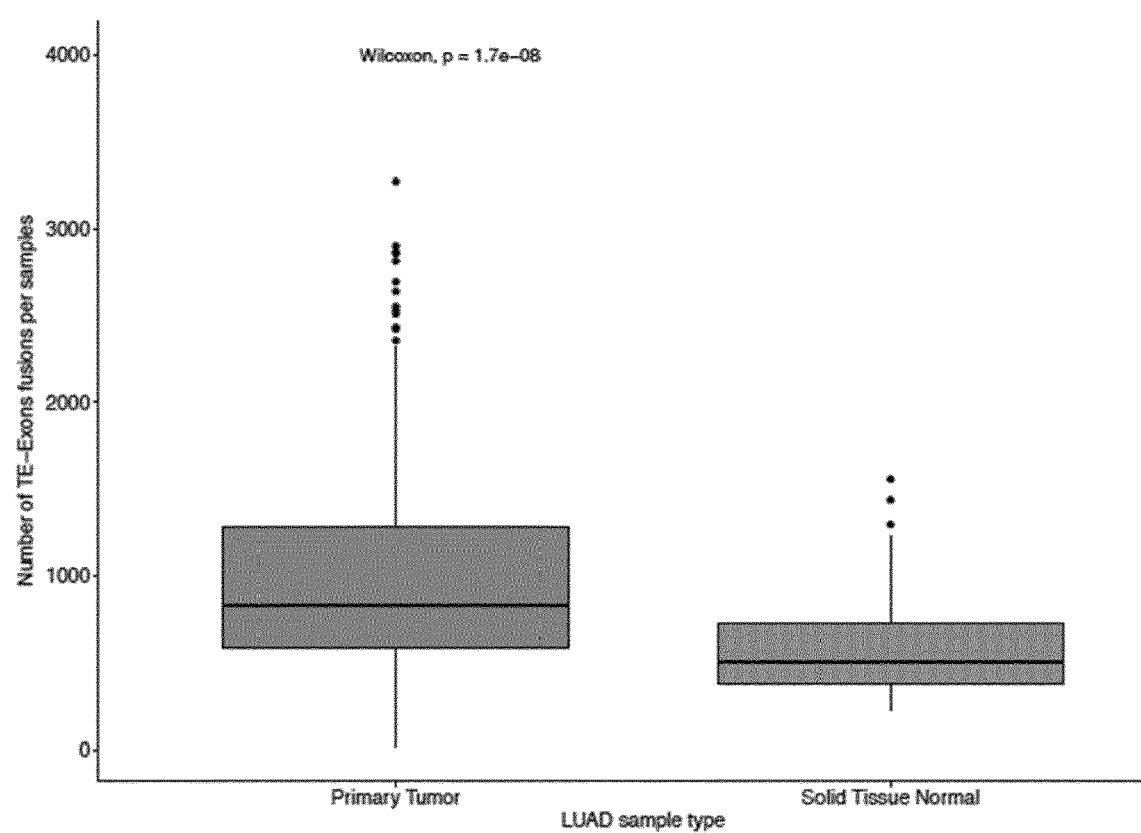
Figure 6A:
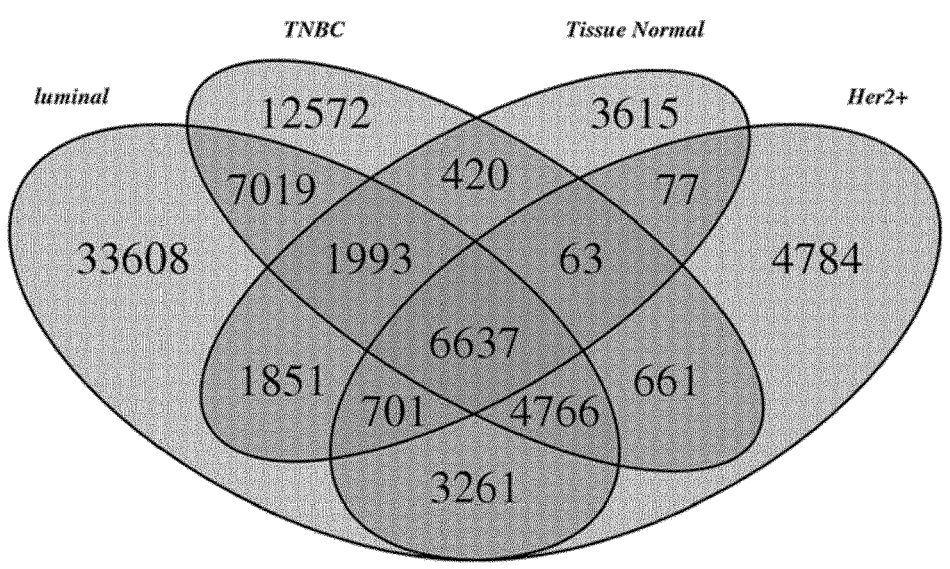
FIG. 6: 8-9 amino acid-long peptides predicted from TE-gene fusion products from each sample were tested in silico for binding to the predicted HLA alleles expressed in the same sample. Shown are peptides with predicted affinity below 500 nM for at least one HLA-A, -B, or -C allele from each sample. (A) Samples of different subtypes of breast cancer (HER2+, TNBC, normal breast tissue and luminal). (B) Samples of different subtypes of lung cancer (non-small cell lung cancer, normal lung tissue).
Figure 6B:
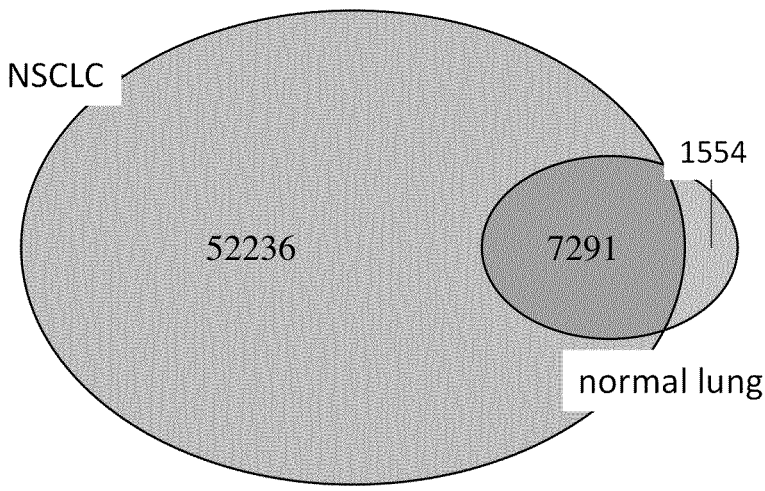
Figure 7A:
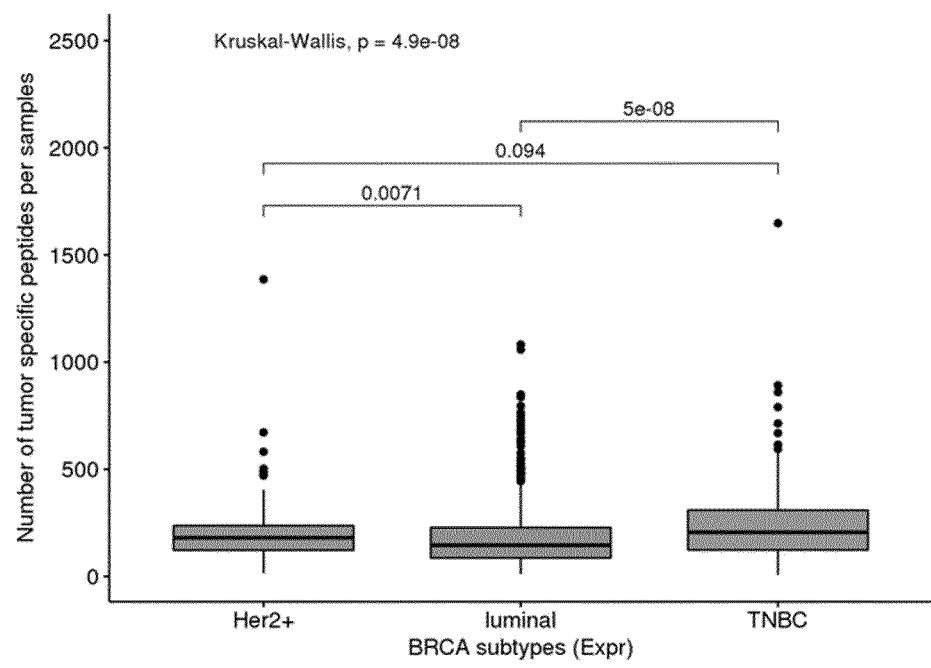
FIG. 7: Distribution of tumor-specific peptides per patient across breast tumor subtypes. (A) Numbers of tumor-specific HLA-binding peptides per subtypes of breast cancer patient are shown. (B) Numbers of predicted tumor neoantigenic peptides shared across luminal subtypes samples (n=784) (abscissa). (C) Numbers of predicted tumor neoantigenic peptides shared across HER2+ subtypes samples (n=100) (abscissa). (D) Numbers of predicted tumor neoantigenic peptides shared across TNBC subtypes samples (n=197) (abscissa).
Figure 7C:
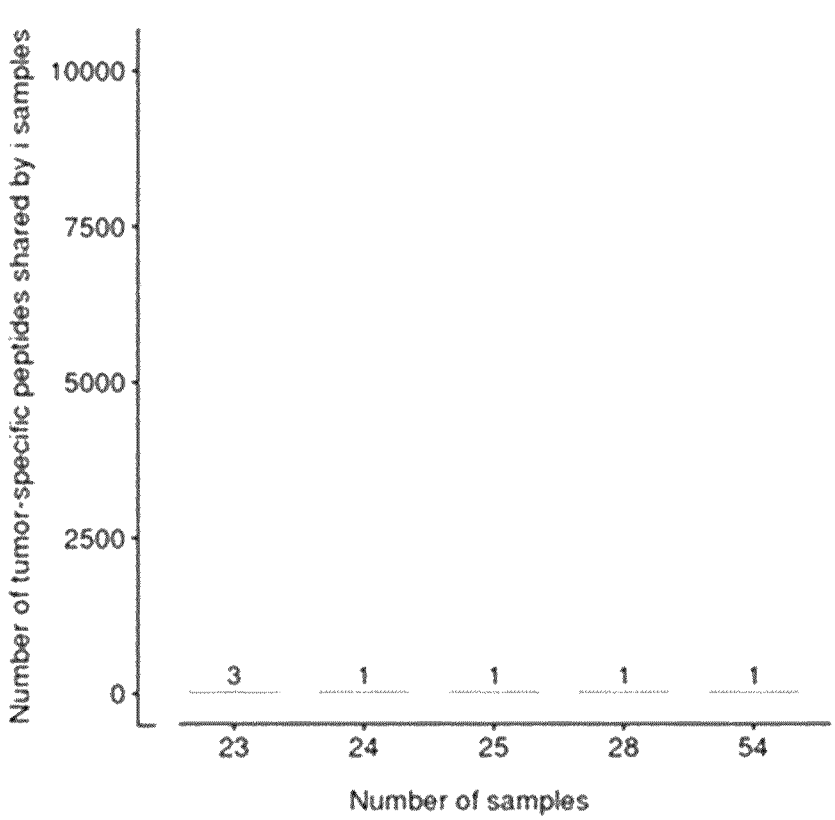
Figure 8A:
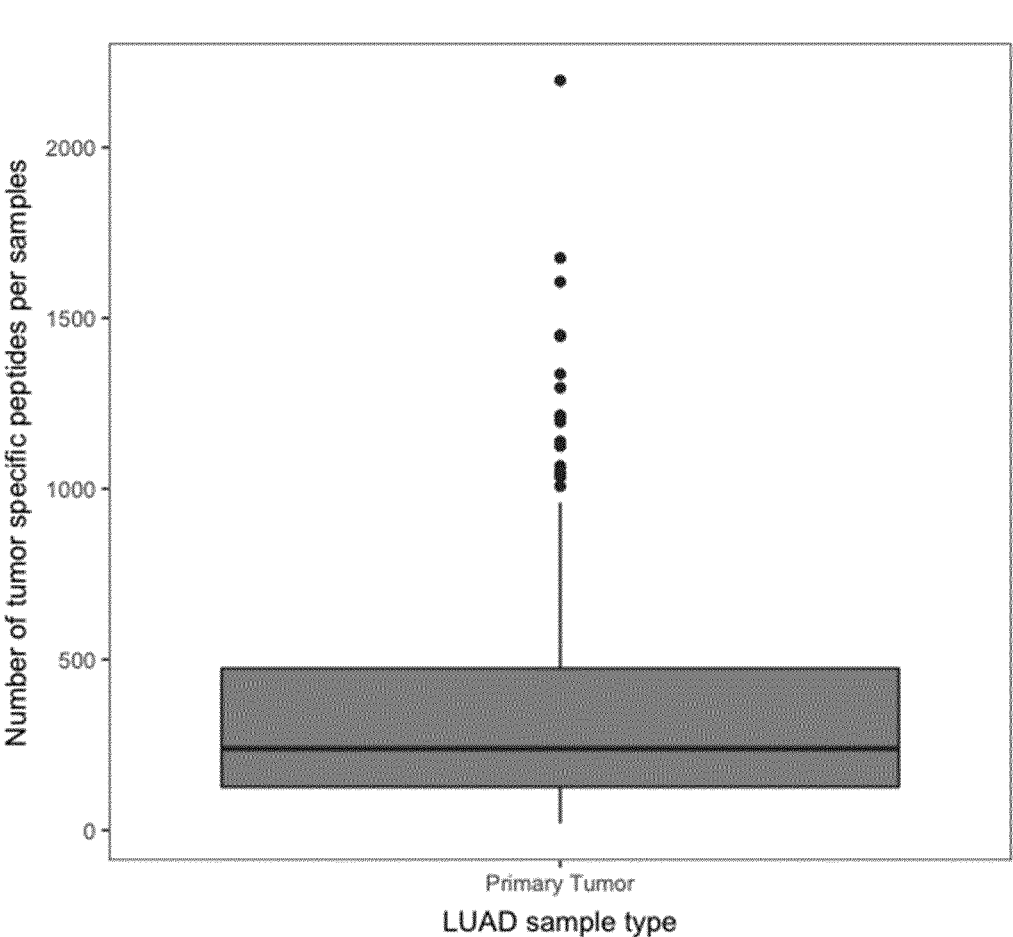
FIG. 8: (A) Numbers of tumor-specific HLA-binding peptides per primary lung adenocarcinomas (LUAD) sample (lung cancer). (B) Distribution of tumor-specific peptides per patient across lung adenocarcinomas. Numbers of predicted tumor neoantigenic peptides shared across primary tumor subtypes samples (n=516) (abscissa).

Short peptides (N25, N26, or SIINFEKL) or DMSO at $10\ \mu g\cdot mL^{-1}$ were used to restimulate T cells. Alternatively, 7 days after secondary immunization, animals were injected subcutaneously with $2.5\cdot10^5$ B16F10-OVA or $5\cdot10^5$ MCA-OVA cells in PBS. Tumor size was measured twice weekly using a manual caliper, and animal health status monitored throughout the experiment timeframe (FIGS. 4A and 4B). Animals were sacrificed when tumor volume reached 1 mm³. Strikingly, we observed that N25L significantly delayed the formation of B16OVA tumors, in a more efficient way than OVA. Moreover, we obtained a similar result upon N26L immunization.

2 Example 2: Identification of Human Lung Adenocarcinoma (LUAD) Neoantigenic Peptides Derived from Fusion Transcripts Composed of a TE Element and an Exonic Sequence 2.1 Material and Methods RNA extraction. Tumour and juxtatumour samples were cut into pieces of #1 mm$^3$ and resuspended in 700 µl RTL lysis buffer (Quiagen) supplemented with 1% β-mercapto-ethanol and homogenized using Perecellys 24 Tissue Homogenizer (Bertin Technologies). Total RNA isolation was performed using RNeasy Micro Kit (Qiagen) following manufacturer instructions. Total RNA from tumour cell lines were extracted from 5·10$^6$ tumor cell lines using the same procedure.

PCR and Sequencing. Primers were designed using APE software. For each sample, 1 µg of RNA was retrotrans-cribed into cDNA using SuperScript III Reverse tran-scriptase (ThermoFisher), as indicated by the provider. PCR reaction was performed using GoTaq G2 Hot Start Poly-marase (Promega). All primers were used in a concentration of 0.5 µM. Reactions were carried out in Veriti™ 96-Well Thermal Cycler (ThermoFisher). PCR products were loaded in LabChip GX (Caliper LifeSciences) and analysed by LabChip GX Software (v4.2).

PCR reactions were repeated for those samples with an amplification product on the expected size. Then, the PCR products were run in a 2% agarose gel SYBR Free Dye (1/10000) (Invitrogen). The specific bands were cut and the DNA products were purified using QIAquick Gel Extraction Kit (Qiagen) following manufacturer instructions. Finally, these products were sequenced by EuroFins Scientific. The resulting sequences were compared to the expected one using Serial Cloner software.

Tetramer formation. HLA-A2 monomers were purchased from ImmunAware® and the formation of tetramers was evaluated with synthetic ER-derived peptides following manufacturer instructions. Briefly, synthetic HLA-A2 monomers were incubated with synthetic peptides during 48 h at 18° C. Tetramerization was done by further incubation of monomers with biotinylated-sepharose. Finally, tetramer formation was measured by flow cytometry using a PE-conjugated anti-β2-microglobulin antibody. As a positive control we used a peptide derived from CMV provided by the manufacturer.

In experiments addressed to evaluate the presence of specific CD8+ T cells, the tetramerization step was per-formed by incubating the monomers with different combi-nations of fluorescent streptavidin (PE, APC, PE-Cy5, PE-CF594, BV421, BV711 and FITC).

Priming of naïve CTLs. PBMCs were obtained by Ficoll gradient separation from HLA-A2+ healthy blood donors. CD14+, CD4+ and CD8+ cells were purified by positive selection using magnetic beads (Miltenyi Biotec). While CD4+ and CD8+ T cells were cryopreserved until the experiment day, CD14+ fraction was cultured in the pres-ence of IL-4 (50 ng/mL) and GM-CSF (10 ng/mL) at 106 cells/mL during 5 days to obtain moDCs. After this period of time, the moDCs were matured with LPS and incubated with synthetic ER-derived peptides at a final concentration of 1 µg/mL for 2 hours. Finally, peptide-loaded moDCs were co-cultured with autologous CD4+ and CD8+ T cells in culture medium supplemented with with IL-2 (10 U/ml) and IL-7 (100 ng/ml). The ER-derived peptide stimulation of specific CD8+ CTL populations was assessed by MHC-I tetramer staining by flow cytometry using a combination of two-color tetramer for each peptide.

Tetramer Staining. Cells were resuspended in PBS, stained with Live/Dead Aqua-405 nm (ThermoFisher) dur-ing 20 minutes at 4° C. and washed once. After that, cells were resuspended in PBS-1% BSA containing the mix of SA-coupled tetramers and incubated in the dark at room temperature during 20 minutes. Without further washing, surface antibodies were added in PBS-1% BSA and cells were incubated 20 minutes in the dark at 4° C. Surface antibodies were a combination of anti-CD3-BV650+ anti-CD8-PECy7 in combination with anti-CCR7-AF700+anti-CD45RA-BUV395 when required. Finally, cells were washed twice and resuspended in FACS buffer for flow cytometry analysis.

CTL-clones generation. Tetramer positive cells were single-cell FACS sorted (ARIA-sorter, BD) in U bottom 96-well plates. Sorted cells were collected in 100 µl of RPMI 10% human serum AB (Sigma-Aldrich) containing 150.000 feeders' cells. Finally, 100 µl of AIM-medium containing IL-2 (3000 IU/ml) and anti-CD3 (100 µg/ml, OKT3 clone from Miltenyi) were added and cells were cultured during 15-20 days maximum. When evident cell growth was observed in wells, we perform a second round of expansions with new feeders' cells for an additional period of 15 days maximum. Cells were feed and split as necessary during this period with the same culture media (AIM-RPMI 50/50+5% Human Serum) but only containing IL-2 at 500 IU/ml. Finally, expanded clones were checked for their specificity by FACs-tetramer staining and only clones with >85% of tetramer positive clones were used for further analysis.

Killing assays. To perform killing assays, xCELLigence RTCA S16 Real Time Cell Analyzer was used. H1650 cell-line were plated at 0.5×10$^6$ cells/ml in pre-coated 16 well plates. One day after, cells were incubated or not during 1 h with different concentration of the correspondent syn-thetic peptides. After that, cells were washed twice with culture medium and incubated or not for additional 30 minutes with anti-MHC-I antibodies (clone W6/32, 50 µg/well) or isotype control at the same concentration. With-out additional wash, CTL-clones were added at the corre-spondent ratio. The complete assay was done in free-serum culture medium in a final volume of 200 at 37° C. connected to the xCELLigence system. Impedance variation (cell-index) was measured in real-time during 40 h. Each condi-tion was performed by duplicates.

Cytokine secretion and Jurkat cells activation. 50.000 H1650 cells were plated in 96-well plate in culture medium supplemented with 5% of fetal bovine serum. The day after, cells were culture during 1-2 h with synthetic peptides at different final concentrations. After that, cells were washed twice, CTL-clones were added at 1:1 ratio and co-cultured during 18 h with peptide-loaded target cells. Culture super-natants were collected and cytokine concentration analyzed by cytokine beads arrays (CBA, BD Biosciences) following manufacturer's instructions.

The same experiment was performed using transduced Jurkat cells instead of CTL-clones and two different types of target cells: H1650 and H1395 cell lines. In this assay, after co-cultured with peptide-loaded target cells, Jurkat cells were assessed by flow cytometry analyzing the expression of reporter markers. PMA/Ionomycin was used as positive control to activate Jurkat cells.

Tissues and Blood samples. Lung tumor, juxta tumor and lymoh nodes samples were cut into small pieces and digested using a mix of collagenase-I (2 mg/ml), hyaluroni-dase (2 mg/ml) and DNasa (25 µg/ml) in a final volume of 2 ml culture medium ($CO_2$ independent medium+5) during 40 min at 37° C. After digestion single cell suspensions were collected through a cell Strainer and washed. Tumor and Juxta tumor suspensions were enriched on lymphocyte fractions by a ficoll gradient. After that cells were staining for tetramer analysis by FACs as described before.

Blood samples were seeded on a ficoll gradient and PBMCs were isolated. After that, PBMCs were enriched for CD8+ T cells using EasyStep Human CD8+ T cell Enrichment Kit (STEMCELL Technologies). Finally, enriched cells were stained for tetramer analysis as described before.

Tumor infiltrating lymphocytes (TILs) cultures. Tumor tissue was cut into small pieces (1-3 $mm^3$ size, 6-12 pieces maximum). Each tumor fragment was transferred into individual wells from 24-well plates and cultured in a final volume of 2 ml RPMI 10% Human Serum+IL-2 6000 IU/ml. Cells were feed/split as necessary during 15-20 days and cryopreserve or analyzed for tetramer staining.

TCR cloning. Total RNA was extracted from CTL-clones and retrotranscribed into cDNA using SuperScript III (ThermoFisher). TCRα and β were amplified by PCR as described in Li et al 2019. DNA products were run in 2% agarose gels and sequenced after gel band extraction (Qiagen). TCR V regions (α and β) were concatenated with murine TCR constant chain and cloned into a PEW-pEF1A-inactEGFP vector and amplified in transformed bacteria.

Jurkat transduction. Lentivirus particles were produced by HEK-293FT cell line transfected with TCR-expression plasmids together with envelope (pVSVG) and packaging (ps-PAX2) plasmids. After 64 h, supernatant was collected and lentivirus particles were concentrated using 100 kDa centrifugal filter (Sigma-Aldrich). Lentivirus suspension was transferred by spinoculation into TCR-negative Jurkat cells expressing reporter genes (NFAT-GPF, NF-KB-CFP and AP-1-mCherry). After 5 days, transduction efficiency was evaluated by FACS using anti-murine TCR-β antibody (Clone H57-597). This Jurkat cells were described in Rosskopf S. et al. 2018.

Mass spectrometry data analysis. Public immunopeptidomics raw data derived from MHC-eluted peptides were analysed using ProteomeDiscoverer 1.4 (ThermoFisher) with the following parameters: no-enzyme, peptide length 8-15 aa, precursor mass tolerance 20 ppm and fragment mass tolerance 0.02 Da. Methionine was enabled as variable modification and a false discovery rate (FDR) of 1% was applied. MS/MS spectra were searched against the human proteome from Uniprot/SwissProt (updated 6 Mar. 2020) concatenated with the list of all fusion transcripts-derived proteins from lung TCGA projects. Finally, peptides matching with Uniprot database or with translated fusion transcripts present in lung normal samples were discarded.

2.2 Results: Identification of Fusion Transcript Sequences Encoding Tumor Neoantigenic Peptide in Human Subject

2.2.1 Characterization of Neoantigens

First the TE-Exon fusion transcript landscape was characterized in normal samples from TCGA public database. A total of 8876 unique fusions were identified in 679 normal samples from 19 different tissues (bile duct, bladder, brain, breast, cervical, colon, head and neck, kidneys, liver, pancreas, PCPG, prostate, rectum, sarcoma, skin, thymus, thyroid, uterine). Specific fusions to each tissue type were found with a very small portion of pan-tissue fusion transcripts. These results suggest that a dedicated tissue specific regulatory mechanism is associated with these fusion transcripts.

Then the number of identified fusions in 514 LUAD samples from TCGA has been compared to their 59 normal associated pulmonary samples present in TCGA. On average, 235 fusions were identified in NSCLC samples, compared with 200 in healthy lung samples (Wilcoxon pvalue=$9\times10.^{-10}$). 8269 total unique fusions were identified in NSCLC tumors.

A first category of fusions called TSF (tumor specific fusion) was obtained as those found in at least 1% of tumor samples and in none of the normal samples. 210 fusions were thus defined as TSF.

Some high-frequency fusion transcripts in tumors and low frequency in normal cells may also be good candidates for neo-antigens. Thus, a second category called TAF (tumor associated fusion) was notably defined as fusions present in less than 4% of normal tissues, notably less than 2%, and more than 10% of the tumors and that is over expressed in tumors compared to normal tissue samples.

Tables 3 and 4 (see below) describe the fusion according to whether the Exon or the TE is the donor. The first column indicates the frequency of the fusion in the NSCLC cohort. The columns Donor and Acceptor introduce the type of each element. All the columns starting with "Donor" (respectively "Acceptor") are information relative to the donor (resp. the acceptor). The sequence of the fusion can be retrieved as follow:

Donor sequence: on chromosome "Donor_Chromosome_X" starting from "Donor_start_X" to "Donor_Breakpoint_X" on strand "Donor_strand_X"

Acceptor sequence: on chromosome "Acceptor_Chromosome_X" starting from "Acceptor_Breakpoint_X" to "Acceptor_end_X" on strand "Donor_strand_X"

Care should be taken to take the reverse complement of the sequence if the fusion is present on the minus strand.

Fusion Sequence:

In order to reconstruct the fusion nucleotide sequence, the sequence of the donor on chromosome "Donor_Chromosome_X" from "Donor_start_X" to "Donor_Breakpoint_X" on strand "Donor_strand_X" and the acceptor sequence on the chromosome "Acceptor_Chromosome_X" starting from "Acceptor_Breakpoint_X" to "Acceptor_end_X" on the strand "Acceptor_strand_X" have been extracted from the Ensembl HG19 human assembly database. It is to be noted that the use of the Ensembl HG19 human database is not limitative and that any other adapted database may be used such as NCBI reference Sequence Database (RefSeq).

Care should be taken to take the reverse complement of the sequence if the fusion is present on the minus strand.

The "fusion sequence" consists of the donor sequence followed by the acceptor sequence.

Nucleotide Sequence of the Fusion Transcript:

On the basis of the known canonical transcripts in which the exon is involved, all the "fusion transcripts" were reconstructed.

When the donor is the exon (see FIG. 9A)

it starts with the beginning of the canonical transcript to the donor exon and replace the complete canonical exon sequence with the fusion sequence. In this case, the fusion transcript stops after the TE sequence of the acceptor.

When the donor is the TE (FIG. 9 B)

The sequence begins at the canonical position of the acceptor exon in the transcript and forget all exons upstream. The canonical sequence of the acceptor exon was replaced with the fusion sequence and the transcript was reconstructed until the end.

Each nucleotide sequence of size k (i.e. from 24 to 75 nucleotides) of the fusion transcript (translation of the first k-mer starts at the first nucleotide of the fusion transcript, translation of the second k-mer starts at the second nucleotide of the fusion transcript, etc.) was then translated into a peptide sequence.

The obtained peptides are then further analyzed with NetMHCpan for MHC binding prediction. Affinity for binding to at least one of the known human alleles was thus predicted, (see also example 1 for further illustration) for each k-mer present in the sequence.

TABLE 3

Coordinates of the fusion sequences for which the donor is the exon. The names of
the columns are the following:
  1. Frequency in LUAD cohort
  2. Donor Chromosome Exon
  3. Donor start Exon
  4. Donor Breakpoint Exon
  5. Donor strand Exon
  6. Donor transcript (i.e. Donor_tx_name_Exon)
  7. Acceptor Chromosome TE
  8. Acceptor Breakpoint TE
  9. Acceptor end TE
  10. Acceptor strand TE
  11. Fusion type
The fusion transcript sequence of table 3 correspond in the same order to SEQ ID NO: 118-
431 (typically line 1 is SEQ ID NO:118, line 2 is SEQ ID NO: 119, line 3 corresponds to SEQ
ID NO: 120 and 121, because of the 2 donor transcripts (ENST00000296474 and
ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|---|---|
| 31% | chr19 | 42265157 | 42265435 | + | ENST00000199764 | chr19 | 42274707 | 42275202 | + | TSA |
| 17% | chr12 | 71509630 | 71509630 | – | ENST00000549357 | chr12 | 71504233 | 71504376 | – | TSA |
| 15% | chr3 | 49927357 | 49927357 | – | ENST00000296474;<br>ENST00000344206 | chr3 | 49927248 | 49927342 | – | TSA |
| 12% | chr5 | 82554349 | 82554496 | + | ENST00000282268;<br>ENST00000338635;<br>ENST00000396027;<br>ENST00000511817 | chr5 | 82606608 | 82606935 | + | TSA |
| 10% | chr3 | 98600384 | 98600384 | – | ENST00000449482;<br>ENST00000326840;<br>ENST00000326857 | chr3 | 98586282 | 98586295 | – | TSF |
| 8% | chrX | 100169327 | 100169610 | – | ENST00000328526;<br>ENST00000372956 | chrX | 100143801 | 100143850 | – | TSF |
| 7% | chrX | 100177782 | 100177782 | – | ENST00000328526;<br>ENST00000372956 | chrX | 100143801 | 100143850 | – | TSF |
| 6% | chr1 | 225156461 | 225156576 | + | ENST00000430092;<br>ENST00000400952;<br>ENST00000366849;<br>ENST00000439375 | chr1 | 225157336 | 225158402 | + | TSF |
| 6% | chr8 | 63502273 | 63502353 | + | ENST00000523211;<br>ENST00000328472 | chr8 | 63546747 | 63547118 | + | TSF |
| 4% | chr4 | 57319769 | 57319927 | + | ENST00000514888;<br>ENST00000264221;<br>ENST00000505164;<br>ENST00000399688;<br>ENST00000512576 | chr4 | 57321183 | 57321327 | + | TSF |
| 4% | chr12 | 113623819 | 113623826 | + | ENST00000552495 | chr12 | 113623998 | 113624117 | + | TSF |
| 4% | chr3 | 32280465 | 32280611 | + | ENST00000458535;<br>ENST00000307526 | chr3 | 32324083 | 32324625 | + | TSF |
| 4% | chr19 | 3868963 | 3868963 | – | ENST00000586578;<br>ENST00000262961;<br>ENST00000438164;<br>ENST00000587212;<br>ENST00000439086 | chr19 | 3855694 | 3856396 | – | TSF |
| 4% | chr4 | 56230241 | 56230438 | + | ENST00000264228 | chr4 | 56252510 | 56252750 | + | TSF |
| 3% | chr10 | 126205749 | 126205840 | + | ENST00000368842 | chr10 | 126251911 | 126252288 | + | TSF |
| 3% | chr1 | 241803184 | 241803184 | – | ENST00000366554;<br>ENST00000331838 | chr1 | 241771682 | 241771840 | – | TSF |
| 3% | chr12 | 56742313 | 56742313 | – | ENST00000314128;<br>ENST00000557235 | chr12 | 56740986 | 56741274 | – | TSF |
| 3% | chr1 | 234546191 | 234546191 | – | ENST00000040877 | chr1 | 234545319 | 234545408 | – | TSF |
| 3% | chr7 | 81964451 | 81964451 | – | ENST00000356860;<br>ENST00000356253;<br>ENST00000423588 | chr7 | 81929467 | 81929664 | – | TSF |
| 3% | chr2 | 89160398 | 89160398 | – | ENST00000390239 | chr2 | 89129384 | 89129429 | – | TSF |
| 3% | chr5 | 54993674 | 54993674 | – | ENST00000396865;<br>ENST00000539768;<br>ENST00000318672; | chr5 | 54993040 | 54993109 | – | TSF |

TABLE 3-continued

Coordinates of the fusion sequences for which the donor is the exon. The names of
the columns are the following:
  1. Frequency in LUAD cohort
  2. Donor Chromosome Exon
  3. Donor start Exon
  4. Donor Breakpoint Exon
  5. Donor strand Exon
  6. Donor transcript (i.e. Donor_tx_name_Exon)
  7. Acceptor Chromosome TE
  8. Acceptor Breakpoint TE
  9. Acceptor end TE
10. Acceptor strand TE
11. Fusion type
The fusion transcript sequence of table 3 correspond in the same order to SEQ ID NO: 118-
431 (typically line 1 is SEQ ID NO:118, line 2 is SEQ ID NO: 119, line 3 corresponds to SEQ
ID NO: 120 and 121, because of the 2 donor transcripts (ENST00000296474 and
ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|---|---|
| | | | | | ENST00000508124; | | | | | |
| | | | | | ENST00000511233; | | | | | |
| | | | | | ENST00000503891; | | | | | |
| | | | | | ENST00000513993; | | | | | |
| | | | | | ENST00000505563; | | | | | |
| | | | | | ENST00000506624; | | | | | |
| | | | | | ENST00000507109 | | | | | |
| 3% | chrX | 119708406 | 119708406 | – | ENST00000404115 | chrX | 119705855 | 119706010 | – | TSF |
| 3% | chr2 | 135223685 | 135223685 | – | ENST00000281924 | chr2 | 135216236 | 135216307 | – | TSF |
| 3% | chr11 | 20981978 | 20982106 | + | ENST00000298925; | chr11 | 21041136 | 21041271 | + | TSF |
| | | | | | ENST00000357134; | | | | | |
| | | | | | ENST00000325319; | | | | | |
| | | | | | ENST00000532434 | | | | | |
| 2% | chr13 | 53307354 | 53307354 | – | ENST00000431550; | chr13 | 53304269 | 53304818 | – | TSF |
| | | | | | ENST00000448904; | | | | | |
| | | | | | ENST00000377962 | | | | | |
| 2% | chr3 | 138289160 | 138289160 | – | ENST00000264982; | chr3 | 138261631 | 138262493 | – | TSF |
| | | | | | ENST00000542237; | | | | | |
| | | | | | ENST00000484888; | | | | | |
| | | | | | ENST00000474781; | | | | | |
| | | | | | ENST00000481834; | | | | | |
| | | | | | ENST00000468900; | | | | | |
| | | | | | ENST00000462419; | | | | | |
| | | | | | ENST00000464035 | | | | | |
| 2% | chr1 | 1255836 | 1255836 | – | ENST00000435064; | chr1 | 1255085 | 1255253 | – | TSF |
| | | | | | ENST00000540437; | | | | | |
| | | | | | ENST00000450926; | | | | | |
| | | | | | ENST00000545578; | | | | | |
| | | | | | ENST00000528879; | | | | | |
| | | | | | ENST00000434694; | | | | | |
| | | | | | ENST00000526797; | | | | | |
| | | | | | ENST00000527719; | | | | | |
| | | | | | ENST00000530031; | | | | | |
| | | | | | ENST00000534345; | | | | | |
| | | | | | ENST00000498476 | | | | | |
| 2% | chr2 | 135470770 | 135470770 | – | ENST00000281924 | chr2 | 135443800 | 135443808 | – | TSF |
| 2% | chr5 | 23976106 | 23976159 | + | ENST00000512559; | chr5 | 24177946 | 24178380 | + | TSF |
| | | | | | ENST00000507936 | | | | | |
| 2% | chr9 | 125054028 | 125054119 | + | ENST00000297908; | chr9 | 125068067 | 125068171 | + | TSF |
| | | | | | ENST00000344641; | | | | | |
| | | | | | ENST00000373723; | | | | | |
| | | | | | ENST00000373729; | | | | | |
| | | | | | ENST00000394315 | | | | | |
| 2% | chrX | 117900807 | 117900939 | + | ENST00000371666 | chrX | 117902549 | 117902902 | + | TSF |
| 2% | chr5 | 31493314 | 31493314 | – | ENST00000511367; | chr5 | 31489188 | 31489272 | – | TSF |
| | | | | | ENST00000344624; | | | | | |
| | | | | | ENST00000442743; | | | | | |
| | | | | | ENST00000513349 | | | | | |
| 2% | chr2 | 89416833 | 89416936 | – | ENST00000490686 | chr2 | 89370042 | 89370075 | – | TSF |
| 2% | chr20 | 29632611 | 29632721 | + | ENST00000278882; | chr20 | 29652086 | 29652324 | + | TSF |
| | | | | | ENST00000358464 | | | | | |
| 2% | chr14 | 66096210; | 66096324 | + | ENST00000360689; | chr14 | 66099743 | 66101298 | + | TSF |
| | | 66096217 | | | ENST00000394586; | | | | | |
| | | | | | ENST00000342677; | | | | | |
| | | | | | ENST00000394585; | | | | | |
| | | | | | ENST00000358307; | | | | | |
| | | | | | ENST00000557164 | | | | | |
| 2% | chr9 | 130678687 | 130678687 | – | ENST00000335791 | chr9 | 130678527 | 130678564 | – | TSF |
| 2% | chr1 | 180283827 | 180283827 | – | ENST00000367595 | chr1 | 180281457 | 180281879 | – | TSF |
| 2% | chr20 | 44333136 | 44333136 | – | ENST00000335769 | chr20 | 44322980 | 44322991 | – | TSF |

TABLE 3-continued

Coordinates of the fusion sequences for which the donor is the exon. The names of
the columns are the following:
 1. Frequency in LUAD cohort
 2. Donor Chromosome Exon
 3. Donor start Exon
 4. Donor Breakpoint Exon
 5. Donor strand Exon
 6. Donor transcript (i.e. Donor_tx_name_Exon)
 7. Acceptor Chromosome TE
 8. Acceptor Breakpoint TE
 9. Acceptor end TE
10. Acceptor strand TE
11. Fusion type
The fusion transcript sequence of table 3 correspond in the same order to SEQ ID NO: 118-
431 (typically line 1 is SEQ ID NO:118, line 2 is SEQ ID NO: 119, line 3 corresponds to SEQ
ID NO: 120 and 121, because of the 2 donor transcripts (ENST00000296474 and
ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|---|---|
| 2% | chr2 | 89512908 | 89512947 | – | ENST00000498435 | chr2 | 89389297 | 89389324 | – | TSF |
| 2% | chr8 | 62546242 | 62546242 | – | ENST00000541428; ENST00000379454; ENST00000522919; ENST00000356457; ENST00000519234; ENST00000518068; ENST00000517903; ENST00000445642; ENST00000517847; ENST00000522835 | chr8 | 62544521 | 62544571 | – | TSF |
| 2% | chr4 | 1102131 | 1102131 | – | ENST00000382968; ENST00000433731; ENST00000511620; ENST00000510715; ENST00000333673 | chr4 | 1101132 | 1101138 | – | TSF |
| 2% | chr6 | 24551662 | 24551662 | – | ENST00000430948; ENST00000535378; ENST00000378214; ENST00000543707 | chr6 | 24548828 | 24548834 | – | TSF |
| 2% | chr1 | 11115838 | 11115838 | – | ENST00000490101; ENST00000376957 | chr1 | 11115464 | 11115465 | – | TSF |
| 2% | chr7 | 55270210 | 55270401 | + | ENST00000455089 | chr7 | 55272949 | 55272949 | + | TSF |
| 2% | chr8 | 42924698; 42924750 | 42924802 | + | ENST00000534420; ENST00000302279; ENST00000533998; ENST00000342116; ENST00000531266; ENST00000533336; ENST00000525699; ENST00000529687 | chr8 | 42925245 | 42925476 | + | TSF |
| 2% | chr2 | 176860281; 176860286 | 176860286 | – | ENST00000392540; ENST00000272748; ENST00000544803; ENST00000445472 | chr2 | 176859008 | 176859011 | – | TSF |
| 2% | chr1 | 63955754 | 63955754 | – | ENST00000371092; ENST00000271002; ENST00000489099; ENST00000283568 | chr1 | 63952444 | 63952998 | – | TSF |
| 2% | chr16 | 2825452 | 2825452 | – | ENST00000262306; ENST00000409906; ENST00000409477; ENST00000494946 | chr16 | 2823822 | 2823948 | – | TSF |
| 2% | chr7 | 16900083; 16900124 | 16900124 | – | ENST00000402239; ENST00000310398; ENST00000414935 | chr7 | 16894536 | 16894625 | – | TSF |
| 2% | chr17 | 79532346; 79532531 | 79532531 | – | ENST00000374747; ENST00000539314; ENST00000572760; ENST00000573876; ENST00000331134; ENST00000573519; ENST00000571714; ENST00000572824; ENST00000573212 | chr17 | 79527702 | 79527706 | – | TSF |
| 2% | chr19 | 55178145; 55178148 | 55178200 | + | ENST00000391733 ENST00000391736; ENST00000270452; | chr19 | 55178294 | 55178458 | + | TSF |

TABLE 3-continued

Coordinates of the fusion sequences for which the donor is the exon. The names of
the columns are the following:
  1. Frequency in LUAD cohort
  2. Donor Chromosome Exon
  3. Donor start Exon
  4. Donor Breakpoint Exon
  5. Donor strand Exon
  6. Donor transcript (i.e. Donor_tx_name_Exon)
  7. Acceptor Chromosome TE
  8. Acceptor Breakpoint TE
  9. Acceptor end TE
10. Acceptor strand TE
11. Fusion type
The fusion transcript sequence of table 3 correspond in the same order to SEQ ID NO: 118-
431 (typically line 1 is SEQ ID NO:118, line 2 is SEQ ID NO: 119, line 3 corresponds to SEQ
ID NO: 120 and 121, because of the 2 donor transcripts (ENST00000296474 and
ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|---|---|
| 2% | chr3 | 48715987; 48715997 | 48715997 | – | ENST00000430952; ENST00000391734; ENST00000434286 ENST00000413374; ENST00000341520; ENST00000416649; ENST00000294129 | chr3 | 48702393 | 48702506 | – | TSF |
| 2% | chr3 | 137906397; 137906427 | 137906441 | + | ENST00000469044; ENST00000461600; ENST00000461822; ENST00000470821; ENST00000471709; ENST00000538260; ENST00000463485; ENST00000393058 | chr3 | 137907243 | 137907252 | + | TSF |
| 2% | chr12 | 93873164 | 93873248 | + | ENST00000549982 ENST00000361630; ENST00000552217; ENST00000393128; ENST00000547098; ENST00000549561; ENST00000548545 | chr12 | 93876129 | 93876286 | + | TSF |
| 2% | chr1 | 53558226 | 53558226 | – | ENST00000371494 | chr1 | 53556655 | 53556736 | – | TSF |
| 2% | chr2 | 143743517 | 143743590 | + | ENST00000264170; ENST00000375773; ENST00000409512 | chr2 | 143745513 | 143745682 | + | TSF |
| 1% | chr12 | 117537030 | 117537030 | – | ENST00000470612; ENST00003335209; ENST00000541210; ENST00000462502; ENST00000392545 | chr12 | 117513606 | 117513652 | – | TSF |
| 1% | chr11 | 63365533 | 63365533 | – | ENST00000323646; ENST00000415826 | chr11 | 63360665 | 63361041 | – | TSF |
| 1% | chr16 | 14782022 | 14782022 | – | ENST00000438167 ENST00000567462 | chr16 | 14779702 | 14779829 | – | TSF |
| 1% | chr7 | 22532184 | 22532184 | – | ENST00000406890 ENST00000404369; ENST00000424363 | chr7 | 22512853 | 22512874 | – | TSF |
| 1% | chr5 | 1802435 | 1802488 | + | ENST00000274137; ENST00000469176 | chr5 | 1811112 | 1811428 | + | TSF |
| 1% | chr7 | 93516573 | 93516573 | – | ENST00000451238; ENST00000222543 | chr7 | 93492029 | 93492238 | – | TSF |
| 1% | chr14 | 106235574 | 106235574 | – | ENST00000390551 | chr14 | 106216701 | 106216951 | – | TSF |
| 1% | chr22 | 47071365 | 47071449 | + | ENST00000406902; ENST00000361034; ENST00000408031 | chr22 | 47078308 | 47078350 | + | TSF |
| 1% | chr16 | 16381600 | 16381719 | + | ENST00000399336; ENST00000263012; ENST00000538468 | chr16 | 16382422 | 16382605 | + | TSF |
| 1% | chr7 | 22532184 | 22532184 | – | ENST00000406890; ENST00000404369; ENST00000424363 | chr7 | 22531483 | 22531483 | – | TSF |
| 1% | chr18 | 56807181 | 56807267 | + | ENST00000587834; ENST00000299714; ENST00000588875 | chr18 | 56814218 | 56814267 | + | TSF |
| 1% | chr22 | 48885405 | 48885516 | + | ENST00000402357; ENST00000336769 | chr22 | 48915770 | 48916108 | + | TSF |
| 1% | chr10 | 75555297 | 75555421 | + | ENST00000604729; ENST00000603114; ENST00000604524; | chr10 | 75556079 | 75556138 | + | TSF |

TABLE 3-continued

Coordinates of the fusion sequences for which the donor is the exon. The names of
the columns are the following:
  1. Frequency in LUAD cohort
  2. Donor Chromosome Exon
  3. Donor start Exon
  4. Donor Breakpoint Exon
  5. Donor strand Exon
  6. Donor transcript (i.e. Donor_tx_name_Exon)
  7. Acceptor Chromosome TE
  8. Acceptor Breakpoint TE
  9. Acceptor end TE
10. Acceptor strand TE
11. Fusion type
The fusion transcript sequence of table 3 correspond in the same order to SEQ ID NO: 118-
431 (typically line 1 is SEQ ID NO:118, line 2 is SEQ ID NO: 119, line 3 corresponds to SEQ
ID NO: 120 and 121, because of the 2 donor transcripts (ENST00000296474 and
ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|----|----|
| | | | | | ENST00000398706;<br>ENST00000605216;<br>ENST00000433366;<br>ENST00000492395;<br>ENST00000603187;<br>ENST00000412198;<br>ENST00000604754 | | | | | |
| 1% | chr16 | 4401233 | 4401233 | – | ENST00000577031;<br>ENST00000318059;<br>ENST00000571986;<br>ENST00000576217;<br>ENST00000571178 | chr16 | 4398819 | 4398944 | – | TSF |
| 1% | chr1 | 220240644 | 220240644 | – | ENST00000322067;<br>ENST00000469520;<br>ENST00000354807;<br>ENST00000544404;<br>ENST00000414869;<br>ENST00000463953;<br>ENST00000498791;<br>ENST00000480959 | chr1 | 220237757 | 220238024 | – | TSF |
| 1% | chr14 | 106092109 | 106092109 | – | ENST00000390543 | chr14 | 105470421 | 105470731 | – | TSF |
| 1% | chr1 | 53569018 | 53569018 | – | ENST00000371494 | chr1 | 53568657 | 53568729 | – | TSF |
| 1% | chr9 | 5163913 | 5164179 | – | ENST00000381641 | chr9 | 4992433 | 4992489 | – | TSF |
| 1% | chr7 | 8198157 | 8198157 | – | ENST00000402384;<br>ENST00000406470;<br>ENST00000265577;<br>ENST00000396675;<br>ENST00000339809;<br>ENST00000401396;<br>ENST00000422063;<br>ENST00000407906;<br>ENST00000317367 | chr7 | 8197727 | 8198053 | – | TSF |
| 1% | chr8 | 17872093 | 17872349 | + | ENST00000325083;<br>ENST00000519253;<br>ENST00000327578;<br>ENST00000522275 | chr8 | 17873210 | 17873221 | + | TSF |
| 1% | chr2 | 192546672;<br>192546682 | 192546743 | + | ENST00000307849;<br>ENST00000451500;<br>ENST00000425611;<br>ENST00000435931;<br>ENST00000307834;<br>ENST00000410026;<br>ENST00000409510 | chr2 | 192548016 | 192548103 | + | TSF |
| 1% | chr11 | 67786242 | 67786362 | + | ENST00000539229;<br>ENST00000316367;<br>ENST00000007633;<br>ENST00000342456 | chr11 | 67786535 | 67786588 | + | TSF |
| 1% | chr8 | 62546242 | 62546242 | – | ENST00000541428;<br>ENST00000379454;<br>ENST00000522919;<br>ENST00000356457;<br>ENST00000519234;<br>ENST00000518068;<br>ENST00000517903;<br>ENST00000445642;<br>ENST00000517847;<br>ENST00000522835 | chr8 | 62544404 | 62544571 | – | TSF |
| 1% | chr12 | 102547647 | 102547754 | + | ENST00000327680;<br>ENST00000378128;<br>ENST00000541394; | chr12 | 102548605 | 102548938 | + | TSF |

TABLE 3-continued

Coordinates of the fusion sequences for which the donor is the exon. The names of
the columns are the following:
1. Frequency in LUAD cohort
2. Donor Chromosome Exon
3. Donor start Exon
4. Donor Breakpoint Exon
5. Donor strand Exon
6. Donor transcript (i.e. Donor_tx_name_Exon)
7. Acceptor Chromosome TE
8. Acceptor Breakpoint TE
9. Acceptor end TE
10. Acceptor strand TE
11. Fusion type
The fusion transcript sequence of table 3 correspond in the same order to SEQ ID NO: 118-
431 (typically line 1 is SEQ ID NO:118, line 2 is SEQ ID NO: 119, line 3 corresponds to SEQ
ID NO: 120 and 121, because of the 2 donor transcripts (ENST00000296474 and
ENST00000344206 respectively as indicated in col. 6), etc.).

| 1 | 2 | 3 | 4 | 5 | 6 | 7 | 8 | 9 | 10 | 11 |
|---|---|---|---|---|---|---|---|---|----|----|
|  |  |  |  |  | ENST00000358383; ENST00000392911; ENST00000412715; ENST00000417507; ENST00000457614 |  |  |  |  |  |
| 1% | chr19 | 18710375 | 18710375 | – | ENST00000392386 | chr19 | 18709961 | 18710215 | – | TSF |
| 1% | chr10 | 79796952 | 79797062 | + | ENST00000435275; ENST00000440692; ENST00000372360; ENST00000360830 | chr4 | 176584518 | 176584519 | + | TSF |
| 1% | chrX | 41598637 | 41598637 | – | ENST00000421587; ENST00000318588; ENST00000361962; ENST00000378163; ENST00000378158; ENST00000378166; ENST00000442742; ENST00000378154 | chrX | 41557348 | 41557352 | – | TSF |
| 1% | chr10 | 5037511 | 5037511 | – | ENST00000380753; ENST00000421196; ENST00000407674 | chr10 | 5023140 | 5023482 | – | TSF |
| 1% | chr20 | 37384500 | 37384682 | + | ENST00000243903 | chr20 | 37390296 | 37390409 | + | TSF |
| 1% | chr4 | 169086398 | 169086477 | + | ENST00000359299 | chr4 | 169090666 | 169090754 | + | TSF |
| 1% | chr22 | 23165476 | 23165642 | + | ENST00000390317 | chr22 | 23175722 | 23175755 | + | TSF |
| 1% | chr4 | 25759156 | 25759156 | – | ENST00000399878; ENST00000264868; ENST00000502949; ENST00000510448 | chr4 | 25723603 | 25724054 | – | TSF |

TABLE 4

Coordinates of the fusion sequences for which the donor is the TE. The names of the columns are the
following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type
The fusion transcript sequences of table 4 correspond in the same order to SEQ ID NO: 432-910 (with
same reasoning as table 3 above).

| 1 | 2 | 3 | 4 | 5 | 6 | 7 | 8 | 9 | 10 | 11 |
|---|---|---|---|---|---|---|---|---|----|----|
| 51% | chr12 | 122430912 | 122431655 | + | chr12 | 122437622 | 122437850 | + | ENST00000288912 | TSA |
| 50% | chr12 | 122430912 | 122431578 | + | chr12 | 122437622 | 122437850 | + | ENST00000288912 | TSA |
| 42% | chr8 | 104389530 | 104389551 | + | chr8 | 104390255 | 104390471 | + | ENST00000330295; ENST00000520337 | TSA |
| 36% | chr12 | 122430912 | 122431615 | + | chr12 | 122437622 | 122437850 | + | ENST00000288912 | TSA |
| 36% | chr17 | 80440912 | 80441180 | + | chr17 | 80441592 | 80441655; 80441659 | + | ENST00000390006; ENST00000309794; ENST00000345415; | TSA |

TABLE 4-continued

Coordinates of the fusion sequences for which the donor is the TE. The names of the columns are the following:
  1. Frequency in LUAD cohort
  2. Donor Chromosome TE
  3. Donor start TE
  4. Donor Breakpoint TE
  5. Donor strand TE
  6. Acceptor Chromosome exon
  7. Acceptor Breakpoint exon
  8. Acceptor end exon
  9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 32% | chr20 | 44420870 | 44421070 | + | chr20 | 44421316 | 44421386 | + | ENST00000457415;<br>ENST00000577432;<br>ENST00000584513;<br>ENST00000412079<br>ENST00000372622;<br>ENST00000449078;<br>ENST00000456939 | TSA |
| 32% | chr6 | 80021194 | 80022085 | – | chr6 | 79924739 | 79924739 | – | ENST00000275036;<br>ENST00000344726 | TSF |
| 24% | chr7 | 116364854 | 116364901 | + | chr7 | 116371722 | 116371913 | + | ENST00000397752;<br>ENST00000318493;<br>ENST00000436117 | TSA |
| 23% | chr17 | 70713482 | 70713885 | – | chr17 | 70645407 | 70645407 | – | ENST00000255559;<br>ENST00000542342;<br>ENST00000582769 | TSF |
| 22% | chr10 | 5077666 | 5077808 | + | chr10 | 5138602 | 5138769 | + | ENST00000602997;<br>ENST00000605149;<br>ENST00000380554 | TSA |
| 19% | chr10 | 5059958 | 50092 | – | chr10 | 5043873 | 5043873 | – | ENST00000380753;<br>ENST00000421196;<br>ENST00000407674;<br>ENST00000604507;<br>ENST00000455190 | TSA |
| 18% | chr11 | 423924 | 423942 | – | chr11 | 421198 | 421198 | – | ENST00000332826 | TSA |
| 17% | chr5 | 66178759 | 66178848 | + | chr5 | 66195779 | 66195810 | + | ENST00000404260;<br>ENST00000403625;<br>ENST00000406374;<br>ENST00000406039;<br>ENST00000452953;<br>ENST00000432817;<br>ENST00000434115;<br>ENST00000411628;<br>ENST00000490016;<br>ENST00000403666;<br>ENST00000450827 | TSA |
| 16% | chr4 | 100015102 | 10002105 | – | chr4 | 100006367 | 100006367 | – | ENST00000296412;<br>ENST00000512659;<br>ENST00000503130;<br>ENST00000502590;<br>ENST00000505652 | TSA |
| 16% | chr11 | 93467948 | 93468129 | – | chr11 | 93467826 | 93467826 | – | ENST00000393259;<br>ENST00000527169 | TSA |
| 15% | chr17 | 70670228 | 70670643 | – | chr17 | 70645407 | 70645407 | – | ENST00000255559;<br>ENST00000542342;<br>ENST00000582769 | TSA |
| 14% | chr5 | 822923 | 823504 | – | chr5 | 822010 | 822010 | – | ENST00000424784;<br>ENST00000283441 | TSA |
| 12% | chr20 | 31764878 | 31764929 | + | chr20 | 31765953 | 31766034 | + | ENST00000253362;<br>ENST00000354932 | TSA |
| 10% | chr5 | 1474878 | 1475076 | – | chr5 | 1474800 | 1474800 | – | ENST00000475622;<br>ENST00000283415 | TSF |
| 9% | chr19 | 14129234 | 14129243 | + | chr19 | 14141522 | 14141549;<br>14141760 | + | ENST00000585987;<br>ENST00000431365 | TSF |
| 9% | chr7 | 48039432 | 48039725 | – | chr7 | 48035743 | 48035743 | – | ENST00000453071;<br>ENST00000297325;<br>ENST00000412371;<br>ENST00000412142;<br>ENST00000395572;<br>ENST00000453192;<br>ENST00000438771 | TSF |
| 8% | chr10 | 33505378 | 33505616 | – | chr10 | 33502645 | 33502645 | – | ENST00000432372;<br>ENST00000374875; | TSF |

TABLE 4-continued

Coordinates of the fusion sequences for which the donor is the TE. The names of the columns are the following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| | | | | | | | | | ENST00000265371; ENST00000374867; ENST00000395995; ENST00000374821; ENST00000374822; ENST00000374823; ENST00000374816 | |
| 7% | chrX | 107293989 | 107294242 | + | chrX | 107301268 | 107301431 | + | ENST00000415430; ENST00000217957; ENST00000458383 | TSF |
| 5% | chr7 | 7558677 | 7558760 | – | chr7 | 7557468 | 7557468 | – | ENST00000399429; ENST00000444268 | TSF |
| 5% | chr3 | 182832430 | 182833262 | – | chr3 | 182812393 | 182812393 | – | ENST00000265594; ENST00000497830; ENST00000495767; ENST00000476176; ENST00000487634; ENST00000466650; ENST00000486226 | TSF |
| 5% | chr3 | 98584565 | 98586135 | – | chr3 | 98568442 | 98568442 | – | ENST00000449482; ENST00000326840; ENST00000326857 | TSF |
| 4% | chr2 | 143794737 | 143794842 | + | chr2 | 143797997 | 143798227 | + | ENST00000264170; ENST00000409512 | TSF |
| 4% | chr10 | 5056485 | 5057095 | – | chr10 | 5043873 | 5043873 | – | ENST00000380753; ENST00000421196; ENST00000407674; ENST00000604507; ENST00000455190 | TSF |
| 4% | chr12 | 122430912 | 122432103 | + | chr12 | 122437622 | 122437850 | + | ENST00000288912 | TSF |
| 4% | chr12 | 122430912 | 122431795 | + | chr12 | 122437622 | 122437850 | + | ENST00000288912 | TSF |
| 4% | chr22 | 22899861 | 22899965 | – | chr22 | 22893511 | 22893511 | – | ENST00000406503; ENST00000398743; ENST00000398741; ENST00000543184; ENST00000405655; ENST00000402697; ENST00000439106; ENST00000438888; ENST00000420709; ENST00000403441; ENST00000442481 | TSF |
| 4% | chr12 | 117498474 | 117498567 | – | chr12 | 117494691 | 117494691 | – | ENST00000470612; ENST00000335209; ENST00000392545; ENST00000462502 | TSF |
| 4% | chr8 | 104389530 | 104389536 | + | chr8 | 104390255 | 104390471 | + | ENST00000330295; ENST00000520337 | TSF |
| 4% | chr2 | 38982396 | 38983253 | – | chr2 | 38977336 | 38977336 | – | ENST00000313117; ENST00000425778; ENST00000425941; ENST00000446327; ENST00000409276; ENST00000431066; ENST00000443213 | TSF |
| 4% | chr5 | 66178759 | 66179020 | + | chr5 | 66195779 | 66195810 | + | ENST00000404260; ENST00000403625; ENST00000406374; ENST00000406039; ENST00000452953; ENST00000432817; ENST00000434115; | TSF |

TABLE 4-continued

Coordinates of the fusion sequences for which the donor is the TE. The names of the columns are the following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| | | | | | | | | | ENST00000411628;<br>ENST00000490016;<br>ENST00000403666;<br>ENST00000450827 | |
| 4% | chr20 | 45337040 | 45337192 | + | chr20 | 45353680 | 45354963 | + | ENST00000359271 | TSF |
| 4% | chr4 | 57559029 | 57559845 | – | chr4 | 57522178 | 57522178 | – | ENST00000420433;<br>ENST00000554144;<br>ENST00000508121;<br>ENST00000557328 | TSF |
| 4% | chr7 | 56018506 | 56018522 | + | chr7 | 56020872 | 56021011 | + | ENST00000426595 | TSF |
| 4% | chr6 | 117763522 | 117763597 | – | chr6 | 117739669 | 117739669 | – | ENST00000368507;<br>ENST00000368508 | TSF |
| 3% | chr19 | 1114639 | 1114676 | – | chr19 | 1114421 | 1114421 | – | ENST00000361757;<br>ENST00000587024;<br>ENST00000438103 | TSF |
| 3% | chr5 | 147244208 | 147245387 | + | chr5 | 147261009 | 147261211 | + | ENST00000296694 | TSF |
| 3% | chr17 | 39974832 | 39974893 | + | chr17 | 39975462 | 39975651 | + | ENST00000321562 | TSF |
| 3% | chr12 | 122430912 | 122432282 | + | chr12 | 122437622 | 122437850 | + | ENST00000288912 | TSF |
| 3% | chr4 | 57559029 | 57559885 | – | chr4 | 57522178 | 57522178 | – | ENST00000420433;<br>ENST00000554144;<br>ENST00000508121;<br>ENST00000557328 | TSF |
| 3% | chr4 | 872984 | 873014 | – | chr4 | 871597 | 871597 | – | ENST00000314167;<br>ENST00000511163 | TSF |
| 3% | chr22 | 42509838 | 42511212 | – | chr22 | 42483179 | 42483179 | – | ENST00000602404;<br>ENST00000498737 | TSF |
| 3% | chr22 | 29117270 | 29117506 | – | chr22 | 29115473 | 29115473 | – | ENST00000348295;<br>ENST00000382566;<br>ENST00000382578;<br>ENST00000404276;<br>ENST00000328354;<br>ENST00000405598;<br>ENST00000382580;<br>ENST00000433728;<br>ENST00000402731;<br>ENST00000403642;<br>ENST00000439200;<br>ENST00000448511 | TSF |
| 3% | chr8 | 117816470 | 117816753 | + | chr8 | 117861127 | 117861256;<br>117861276 | + | ENST00000517820;<br>ENST00000520733 | TSF |
| 3% | chr16 | 66461229 | 66461334 | + | chr16 | 66503505 | 66503768 | + | ENST00000536005 | TSF |
| 3% | chr17 | 70713482 | 70713885 | – | chr17 | 70709120 | 70709120 | – | ENST00000581581 | TSF |
| 3% | chr17 | 39976225 | 39976301 | + | chr17 | 39976521 | 39976713 | + | ENST00000321562;<br>ENST00000455106;<br>ENST00000544340 | TSF |
| 3% | chr1 | 223720296 | 223720355 | – | chr1 | 223718212 | 223718212 | – | ENST00000430824;<br>ENST00000366872 | TSF |
| 3% | chrX | 151404470 | 151410406 | – | chrX | 151393317 | 151393317 | – | ENST00000370314;<br>ENST00000535043 | TSF |
| 3% | chr16 | 74833176 | 74833256 | – | chr16 | 74774013 | 74774013 | – | ENST00000219368;<br>ENST00000567683;<br>ENST00000569949 | TSF |
| 2% | chr16 | 4708255 | 4708353 | + | chr16 | 4714710 | 4714776 | + | ENST00000262370;<br>ENST00000415496;<br>ENST00000536343;<br>ENST00000587747;<br>ENST00000399577;<br>ENST00000588994;<br>ENST00000586183;<br>ENST00000590790 | TSF |
| 2% | chr1 | 1422590 | 1422685 | + | chr1 | 1423243 | 1423294 | + | ENST00000308647 | TSF |
| 2% | chr7 | 44158104 | 44158351 | – | chr7 | 44157663 | 44157663 | – | ENST00000406581; | TSF |

TABLE 4-continued

Coordinates of the fusion sequences for which the donor is the TE. The names of the columns are the following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 2% | chr10 | 5059958 | 5060092 | − | chr10 | 5043777 | 5043873 | − | ENST00000223361; ENST00000452185; ENST00000433715; ENST00000456038; ENST00000418438 ENST00000380753; ENST00000421196; ENST00000407674; ENST00000604507; ENST00000455190 | TSF |
| 2% | chr8 | 121656402 | 121662337 | − | chr8 | 121644891 | 121644891 | − | ENST00000395601; ENST00000517992 | TSF |
| 2% | chr15 | 43467899 | 43467988 | + | chr15 | 43470805 | 43470909 | + | ENST00000260403 | TSF |
| 2% | chr5 | 58596413 | 58596862 | − | chr5 | 58511794 | 58511794 | − | ENST00000340635; ENST00000360047; ENST00000507116; ENST00000503258; ENST00000405755; ENST00000502484; ENST00000546160; ENST00000309641; ENST00000502575 | TSF |
| 2% | chr14 | 106258470 | 106258725 | − | chr14 | 106209234 | 106209408 | − | ENST00000390548; ENST00000390549; ENST00000390542 | TSF |
| 2% | chrX | 149996757 | 149996779 | − | chrX | 149963959 | 149963959 | − | ENST00000370377; ENST00000466436; ENST00000418547 | TSF |
| 2% | chr14 | 106258470 | 106258725 | − | chr14 | 106237569 | 106237742 | − | ENST00000390551 | TSF |
| 2% | chrX | 123617772 | 123617816 | − | chrX | 123615814 | 123615814 | − | ENST00000371130; ENST00000422452 | TSF |
| 2% | chrX | 100654643 | 100654732 | − | chrX | 100653934 | 100653934 | − | ENST00000218516 | TSF |
| 2% | chr1 | 156716126 | 156716133 | − | chr1 | 156715165 | 156715165 | − | ENST00000357325; ENST00005537739; ENST00000368209; ENST00000368206 | TSF |
| 2% | chr18 | 70839859 | 70840073 | − | chr18 | 70829208 | 70829208 | − | ENST00000581011; ENST00000581862 | TSF |
| 2% | chr5 | 132737208 | 132737281 | − | chr5 | 132736678 | 132736678 | − | ENST00000265342; ENST00000510685 | TSF |
| 2% | chr2 | 89366766 | 89370031 | − | chr2 | 89292018 | 89292223 | − | ENST00000495489 | TSF |
| 2% | chr6 | 32745845 | 32746483 | − | chr6 | 32731247 | 32731247 | − | ENST00000411527; ENST00000435145; ENST00000437316 | TSF |
| 2% | chr1 | 236485526 | 236485567 | − | chr1 | 236433294 | 236433294 | − | ENST00000354619; ENST00000327333 | TSF |
| 2% | chr1 | 224527533 | 224527861 | + | chr1 | 224553581 | 224553693 | + | ENST00000465271; ENST00000366858; ENST00000366857; ENST00000366856 | TSF |
| 2% | chr16 | 74834260 | 74834274 | − | chr16 | 74774013 | 74774013 | − | ENST00000219368; ENST00000567683; ENST00000569949 | TSF |
| 2% | chr18 | 71976895 | 71977013 | − | chr18 | 71930712 | 71930712 | − | ENST00000340533; ENST00000494131; ENST00000397914 | TSF |
| 2% | chr2 | 85823332 | 85823377 | + | chr2 | 85823642 | 85823772 | + | ENST00000441634; ENST00000306368; ENST00000414390; ENST00000443647; ENST00000456023 | TSF |

TABLE 4-continued

Coordinates of the fusion sequences for which the donor is the TE. The names of the columns are the following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 2% | chr14 | 92119780 | 9211 9864 | – | chr14 | 92105594 | 92105594 | – | ENST00000256343; ENST00000557036 | TSF |
| 2% | chr4 | 57559029 | 57559962 | – | chr4 | 57522178 | 57522178 | – | ENST00000420433; ENST00000554144; ENST00000508121; ENST00000557328 | TSF |
| 2% | chr8 | 144690895 | 144690934 | – | chr8 | 144690296 | 144690296 | – | ENST00000220966; ENST00000433751 | TSF |
| 2% | chr12 | 104681506 | 104681628 | + | chr12 | 104682709 | 104682818 | + | ENST00000378070; ENST00000525566; ENST00000429002; ENST00000526691; ENST00000388854; ENST00000542918 | TSF |
| 2% | chr5; chr5 | 52897435; 52897700 | 52897704 | +; + | chr5 | 52899282 | 52899360 | + | ENST00000502423; ENST00000296684; ENST00000506974; ENST00000506765 | TSF |
| 2% | chr11 | 60694460 | 60694542 | + | chr11 | 60694676 | 60694890 | + | ENST00000453848; ENST00000005286 | TSF |
| 2% | chr1 | 23762004 | 23762216 | – | chr1 | 23761111 | 23761111 | – | ENST00000495646; ENST00000336689; ENST00000437606 | TSF |
| 2% | chr7 | 50763231 | 50763289 | – | chr7 | 50742355 | 50742355 | – | ENST00000439599; ENST00000398812; ENST00000403097; ENST00000357271; ENST00000401949; ENST00000439044 | TSF |
| 2% | chr15 | 34452835 | 34453416 | – | chr15 | 34446885 | 34446885 | – | ENST00000256544; ENST00000557877; ENST00000560108; ENST00000559515 | TSF |
| 2% | chr12 | 6458902 | 6458996 | – | chr12 | 6458387 | 6458387 | – | ENST00000360168; ENST00000358945; ENST00000540037; ENST00000228916; ENST00000543768 | TSF |
| 2% | chr7 | 95053024 | 95053104 | – | chr7 | 95045609 | 95045609 | – | ENST00000536183; ENST00000455123; ENST00000433091; ENST00000222572 | TSF |
| 2% | chr19 | 11140024 | 11140045 | + | chr19 | 11141406 | 11141569 | + | ENST00000358026; ENST00000344626; ENST00000429416; ENST00000541122; ENST00000589677; ENST00000444061; ENST00000590574; ENST00000413806; ENST00000450717 | TSF |
| 2% | chr12 | 58189709 | 58189746 | + | chr12 | 58189960 | 58189980; 58190044; 58190366 | + | ENST00000540550; ENST00000457189; ENST00000454289; ENST00000323833; ENST00000350762 | TSF |
| 2% | chr14 | 70466641 | 70466673 | + | chr14 | 70477471 | 70477663 | + | ENST00000361956; ENST00000381280 | TSF |
| 2% | chr10 | 3133726 | 3133857 | + | chr10 | 3141467 | 3141544 | + | ENST00000607886; ENST00000381125; ENST00000381075; ENST00000407806 | TSF |

TABLE 4-continued

Coordinates of the fusion sequences for which the donor is the TE. The names of the columns are the following:
1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 2% | chr7 | 134212336 | 134212386 | + | chr7 | 134215479 | 134215562 | + | ENST00000359579 | TSF |
| 2% | chr2 | 135250006 | 135250213 | – | chr2 | 135223796 | 135223796 | – | ENST00000281924 | TSF |
| 2% | chr7 | 30468003 | 30468120 | – | chr7 | 30465326 | 30465326 | – | ENST00000222823 | TSF |
| 2% | chr17 | 90088 | 90313 | – | chr17 | 69527 | 69527 | – | ENST00000331302; ENST00000323434; ENST00000536489 | TSF |
| 1% | chr7 | 6423751 | 6423803 | + | chr7 | 6426843 | 6426914 | + | ENST00000348035; ENST00000356142 | TSF |
| 1% | chr7 | 95053024 | 95053140 | – | chr7 | 95045609 | 95045609 | – | ENST00000536183; ENST00000455123; ENST00000433091; ENST00000222572 | TSF |
| 1% | chr10 | 5049827 | 5050220 | – | chr10 | 5043873 | 5043873 | – | ENST00000380753; ENST00000421196; ENST00000407674; ENST00000604507; ENST00000455190 | TSF |
| 1% | chr15 | 43431174 | 43431330 | + | chr15 | 43440953 | 43441077 | + | ENST00000564698; ENST00000260403; ENST00000564494 | TSF |
| 1% | chr19 | 50492001 | 50492051 | – | chr19 | 50491749 | 50491749 | – | ENST00000593919; ENST00000316763; ENST00000377011; ENST00000599538; ENST00000443401; ENST00000601341; ENST00000594948; ENST00000601912; ENST00000594092; ENST00000593912 | TSF |
| 1% | chr1 | 26595323 | 26595855 | + | chr1 | 26595951 | 26596105 | + | ENST00000451429; ENST00000476272; ENST00000252992; ENST00000453146 | TSF |
| 1% | chr20 | 43561150 | 43561175 | + | chr20 | 43561713 | 43561826 | + | ENST00000255136; ENST00000217073 | TSF |
| % | chr10 | 5059958 | 5060092 | – | chr10 | 5043783 | 5043873 | – | ENST00000380753; ENST00000421196; ENST00000407674; ENST00000604507; ENST00000455190 | TSF |
| 1% | chr2 | 26947307 | 26947428 | + | chr2 | 26950535 | 26951436 | + | ENST00000302909 | TSF |
| 1% | chr10 | 99600727 | 99601513 | + | chr10 | 99619215 | 99619340 | + | ENST00000370602 | TSF |
| 1% | chr20 | 58402976 | 58403213 | + | chr20 | 58411560 | 58411615 | + | ENST00000359926; ENST00000371015; ENST00000395639; ENST00000541461; ENST00000355648; ENST00000361300; ENST00000395636 | TSF |
| 1% | chr14 | 105641713 | 105641815 | – | chr14 | 105639598 | 105639598 | – | ENST00000392568 | TSF |
| 1% | chr5 | 34913998 | 34914032 | – | chr5 | 34913683 | 34913683 | – | ENST00000382038; ENST00000341754 | TSF |
| 1% | chr4 | 39516293 | 39516533 | – | chr4 | 39515804 | 39515804 | | ENST00000316423; ENST00000501493; ENST00000506179; ENST00000515021; ENST00000514106; ENST00000509391; ENST00000505698 | TSF |

TABLE 4-continued

Coordinates of the fusion sequences for which the donor is the TE. The names of the columns are the following:
  1. Frequency in LUAD cohort
  2. Donor Chromosome TE
  3. Donor start TE
  4. Donor Breakpoint TE
  5. Donor strand TE
  6. Acceptor Chromosome exon
  7. Acceptor Breakpoint exon
  8. Acceptor end exon
  9. Acceptor strand exon
10. Acceptor transcript
11. Fusion type
The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 1% | chr8 | 140818301 | 140818376 | – | chr8 | 140744445 | 140744445 | – | ENST00000389327; ENST00000389328; ENST00000520857; ENST00000438773 | TSF |
| 1% | chr20 | 44442461 | 44442685 | + | chr20 | 44443023 | 44443109 | + | ENST00000356455; ENST00000405520; ENST00000335046; ENST00000372568 | TSF |
| 1% | chr17 | 66244121 | 66244199 | + | chr17 | 66244785 | 66244846 | + | ENST00000584837 | TSF |
| 1% | chr17 | 17051276 | 17051346 | + | chr17 | 17053458 | 17053547 | + | ENST00000395811; ENST00000444976; ENST00000395804; ENST00000341712; ENST00000584067 | TSF |
| 1% | chr6 | 39267897 | 39268149 | – | chr6 | 39267513 | 39267513 | – | ENST00000373231 | TSF |
| 1% | chr20 | 25840234 | 25840376 | – | chr20 | 25755948 | 25755948; 25755972 | – | ENST00000376403; ENST00000584071 | TSF |
| 1% | chr2 | 90168849 | 90168893 | + | chr2 | 90193334 | 90193424 | + | ENST00000390275 | TSF |
| 1% | chr19 | 50174724 | 50174836 | + | chr19 | 50176955 | 50177005; 50177034 | + | ENST00000441864; ENST00000246785; ENST00000598306; ENST00000600947 | TSF |
| 1% | chr11 | 85339 945 | 85340247 | + | chr11 | 85342731 | 85342852 | + | ENST00000358867; ENST00000534341 | TSF |
| 1% | chr19 | 17421511 | 17421655 | + | chr19 | 17424832 | 17424912 | + | ENST00000593466; ENST00000359866; ENST00000596582 | TSF |
| 1% | chr3 | 32323981 | 32324151 | + | chr3 | 32398865 | 32399038 | + | ENST00000307526 | TSF |
| 1% | chr4 | 57559029 | 57559925 | – | chr4 | 57522178 | 57522178 | – | ENST00000420433; ENST00005554144; ENST00000508121; ENST00000557328 | TSF |
| 1% | chrX | 107265928 | 107266261 | + | chrX | 107301268 | 107301431 | + | ENST00000415430; ENST00000217957; ENST00000458383 | TSF |
| 1% | chr2 | 143715736 | 143715823 | + | chr2 | 143718193 | 143718339 | + | ENST00000264170; ENST00000375773; ENST00000409512 | TSF |
| 1% | chr20 | 25841897 | 25842039 | – | chr20 | 25755948 | 25755948; 25755972 | – | ENST00000376403; ENST00000584071 | TSF |
| 1% | chr8 | 98817265 | 98817331 | + | chr8 | 98817581 | 98817692 | + | ENST00000445593; ENST00000521545; ENST00000517924 | TSF |
| 1% | chr17 | 45698288 | 45698367 | + | chr17 | 45699 34 | 45699286 | + | ENST00000530173; ENST00000322157; ENST00000544660; ENST00000528565 | TSF |
| 1% | chr19 | 46194383 | 46194670 | – | chr19 | 46191824 | 46191824 | – | ENST00000342669; ENST00000588301; ENST00000590212 | TSF |
| 1% | chr21 | 38272435 | 38272892 | – | chr21 | 38269431 | 38269431 | – | ENST00000336648; ENST00000399120 | TSF |
| 1% | chr4 | 162585892 | 162585968 | – | chr4 | 162577646 | 162577646 | – | ENST00000306100; ENST00000379164; ENST00000536695; ENST00000427802 | TSF |
| 1% | chr4 | 40352026 | 40352049 | + | chr4 | 40355996 | 40356537 | + | ENST00000310169 | TSF |
| 1% | chr20 | 25843554 | 25843696 | – | chr20 | 25755948 | 25755948; 25755972 | – | ENST00000376403; ENST00000584071 | TSF |

TABLE 4-continued

Coordinates of the fusion sequences for which the donor is the TE. The names of the columns are the following:

1. Frequency in LUAD cohort
2. Donor Chromosome TE
3. Donor start TE
4. Donor Breakpoint TE
5. Donor strand TE
6. Acceptor Chromosome exon
7. Acceptor Breakpoint exon
8. Acceptor end exon
9. Acceptor strand exon
10. Acceptor transcript
11. Fusion type The fusion transcript sequences of table 4 correspond in the same order to SEQ ID NO: 432-910 (with same reasoning as table 3 above).

| 1 | 2 | 3 | 4 | 5 | 6 | 7 | 8 | 9 | 10 | 11 |
|---|---|---|---|---|---|---|---|---|---|---|
| 1% | chrX | 138072586 | 138072670 | – | chrX | 137939841 | 137939841 | – | ENST00000370603; ENST00000436198; ENST00000455663; ENST00000448673 | TSF |
| 1% | chr2 | 97560868 | 97560977 | – | chr2 | 97559788 | 97559788 | – | ENST00000327896; ENST00000417561; ENST00000490605 | TSF |
| 1% | chr11 | 60933230 | 60933962 | – | chr11 | 60901679 | 60901679 | – | ENST00000301765; ENST00000538036 | TSF |
| 1% | chr9 | 130929707 | 130929818 | – | chr9 | 130929443 | 130929443 | – | ENST00000372954; ENST00000393608; ENST00000541172; ENST00000325721; ENST00000357558; ENST00000538431; ENST00000277465; ENST00000372948; ENST00000372938; ENST00000415526 | TSF |
| 1% | chr21 | 39513161 | 39513404 | + | chr21 | 39528398 | 39528496 | + | ENST00000357704; ENST00000400477 | TSF |
| 1% | chr8 | 63314966 | 63315263 | + | chr8 | 63492098 | 63492235 | + | ENST00000523211; ENST00000524201; ENST00000328472 | TSF |
| 1% | chr4 | 186460593 | 186460994 | – | chr22 | 23243156 | 23243475 | + | ENST00000390323 | TSF |
| 1% | chr12 | 8864869 | 8864879 | + | chr12 | 8866407 | 8866637 | + | ENST00000537189 | TSF |
| 1% | chr10 | 5059958 | 5060040 | – | chr10 | 5043873 | 5043873 | – | ENST00000380753; ENST00000421196; ENST00000407674; ENST00000604507; ENST00000455190 | TSF |
| 1% | chr7 | 65418154 | 65418399 | + | chr7 | 65419061 | 65419287; 65419400 | + | ENST00000360768; ENST00000434382 | TSF |
| 1% | chr1 | 156305244 | 156305264 | – | chr1 | 156304709 | 156304709 | | ENST00000295688; ENST00000368258; ENST00000413555; ENST00000496684; ENST00000478640; ENST00000415548 | TSF |

81

82

The peptides were then further screened against a reference proteome, typically for human subject against all sequences present in Uniprot (representing all the sequences encoded in the human exome). Peptides were considered equal to those in Uniprot if they had the same amino acid sequence or if they only differed in the amino acid in the first or last position. All these equal sequences were then discarded from the candidate list. 117 peptide sequences derived from these 230 fusion transcripts where thus predicted to bind to HLA-A2: 01 (see table 5 below).

TABLE 5

| Peptides LUAD | |
|---|---|
| SEQ ID | Peptide sequence |
| 1 | RLLHLESFL |
| 2 | TLMNLVQVL |
| 3 | ILHSLVTGV |
| 4 | FMMEQVGLA |
| 5 | AMDGKELSL |
| 6 | TLAYGKYYI |
| 7 | GLIQLIWLA |
| 8 | GMVDGGSNI |
| 9 | YLWTTFFPL |
| 10 | ALWEAKMII |
| 11 | WLSSRVTQL |
| 12 | AILPKANTV |
| 13 | VLLFEVELV |
| 14 | GLDTGLQGM |
| 15 | SLLDGTQLF |
| 16 | GLPTGYLFV |
| 17 | LLDRFGYHV |
| 18 | SLLEETQAI |
| 19 | MLLVQPAEL |
| 20 | GLLNISHTA |
| 21 | HLYEPWFPV |
| 22 | YLQGLPLPL |
| 23 | KAVEGILAV |
| 24 | MIYEENNRL |
| 25 | YLPYFLKSL |
| 26 | GLYSLSSVV |
| 27 | LMISRTPEV |
| 28 | LLGGPSVFL |
| 29 | ILSGYGPCV |
| 30 | FLPDLDRPL |
| 31 | AMDGKELSL |

TABLE 5-continued

| Peptides LUAD | |
|---|---|
| SEQ ID | Peptide sequence |
| 32 | RMDFEDLGL |
| 33 | TLIFNPTEI |
| 34 | LLPGLLLLL |
| 35 | LLLVHQHAV |
| 36 | FLDDAPPGT |
| 37 | VLIRYVWTL |
| 38 | YLCGHLHTL |
| 39 | VLSQLTILI |
| 40 | TLGGLMPVL |
| 41 | FLQGSITFI |
| 42 | MLLLYIWQV |
| 43 | YLKIMPVHL |
| 44 | HTLGGLMPV |
| 45 | YIMARVLFV |
| 46 | FILRTDHYI |
| 47 | IMSSAIAYL |
| 48 | FIIGILQLA |
| 49 | YLLQEIYGI |
| 50 | GVFPVVIQA |
| 51 | ALVHLPSQL |
| 52 | GLHPAKPQV |
| 53 | MLVTWELAL |
| 54 | VLLTNTIWL |
| 55 | ALVHLPSQL |
| 56 | CLIDEMPEA |
| 57 | ALMGGFMKT |
| 58 | LLLHLPLXL |
| 59 | TLQDKNLGL |
| 60 | ILANLPPAL |
| 61 | PLWDGMAGL |
| 62 | GLDHQTHPL |
| 63 | GMFLLPPQL |
| 64 | RLADHLSFC |
| 65 | RMRDQLPAL |
| 66 | GLLHAEVAL |
| 67 | SLQNCQVSV |
| 68 | VISAFPSEV |
| 69 | ALAIAALEL |

TABLE 5-continued

| Peptides LUAD | |
|---|---|
| SEQ ID | Peptide sequence |
| 70 | VLDGLDVLL |
| 71 | ELFPPLFMA |
| 72 | FLIVAEILI |
| 73 | IVAEILISL |
| 74 | KAVEGILAV |
| 75 | YLPHLPQVL |
| 76 | MLLDPMGGI |
| 77 | RLLHLESFL |
| 78 | YLAYILYFV |
| 79 | LMTSSIMSV |
| 80 | MLMKTVWQA |
| 81 | SLQPEDMAL |
| 82 | KILTYFPMV |
| 83 | FLGTRVTRV |
| 84 | SLMQSGSPV |
| 85 | VLMWTMAHL |
| 86 | LLGETKVYV |
| 87 | KILTYFPMV |
| 88 | SLLERGLEA |
| 89 | VLSSLNVPL |
| 90 | FLERKSIRV |
| 91 | FVGSSTFYL |
| 92 | FLYTGDFFL |
| 93 | SVGPFALTV |
| 94 | NLALPLPKV |
| 95 | VLESGLYQV |
| 96 | MLVAITVLI |
| 97 | FMDDAKILF |
| 98 | ALVHLPSQL |
| 99 | ILTASITSI |
| 100 | AMDGKELSL |
| 101 | SLGWNISGV |
| 102 | MISAFPNEV |
| 103 | RLTHELPGI |
| 104 | LLFSDGEKV |
| 105 | RLNESTTFV |
| 106 | KLEELKSFV |
| 107 | SINEEIQTV |

TABLE 5-continued

| Peptides LUAD | |
|---|---|
| SEQ ID | Peptide sequence |
| 108 | RLHDGPLRA |
| 109 | MISAFPNEV |
| 110 | ILHTSVPFL |
| 111 | YLENMVSGV |
| 112 | QLLGRLESL |
| 113 | RLLHLESFL |
| 114 | ALLRQMEGI |
| 115 | TLNKDFQEV |
| 116 | IMEQGDLSV |
| 117 | RLLHLESFL |

2.2.2 Validation on HLA-A2 Associated Peptides

Given that HLA-A2 allele is expressed in almost 50% of the Caucasian population, together with the existence of different technical tools, validations were focused on HLA-A2-associated peptides.

In the following paragraphs TE-Exon derived-transcripts is used interchangeably with "fusion transcripts" and the term "TE-derived peptides" is used interchangeably with "fusion transcripts-derived peptides.

Expression of TE-Exon Derived-Transcripts in Lung Adenocarcinoma Samples

To experimentally validate the predicted TE-Exon transcripts, the expression by PCR in LUAD tumor samples and tumor cell lines was validated firstly. Specific primers for each chimeric fusion were thus designed, in order to have one of them binding to the TE part and the other to the Exon part of the fusion. The results were further confirmed by sequencing of the PCR products.

In particular, specific primers were designed in such a way that the forward primer was binding in the "donor" sequence and the reverse primer was binding in the "acceptor" sequence of the reconstructed fusion sequence. PCR reactions were run on RNA derived from lung tumor samples and human tumor cell lines. Amplifications products were seeded on agarose gels and bands found on the expected size were cut and sequenced. Finally, sequenced PCR products were compared with the reconstructed fusion sequence.

Using this approach, it was possible to confirm the presence of predicted fusion transcripts both in LUAD tumor samples and tumor cell lines. Table 6 below summarizes the results found for 8 of the most frequent chimeric fusions with a predicted peptide associated to bind with high affinity to HLA-A2 allele.

Most frequent fusion transcript validation. The most frequent fusions peptides were validated by PCR in 15 LUAD tumor samples and 6 LUAD tumor cell lines. The status 'Yes' or 'No in the table below indicates the presence or absence of the PCR product on the expected size. When the PCR product was further validated by sequencing, is denoted as 'Yes'.

| | | TE-Exon fusion derived-peptides asociated to bind HLA-A2 Frequency | | | |
|---|---|---|---|---|---|
| | | 119 | 48 | 28 | 24 |
| | | peptide sequence | | | |
| | | RLLHLESFL | MLMKTVWQA | FLGTRVTRV | AILPKANTV |
| LUAD | H1975 | Yes | Yes | No | No |
| tumor | H1650 | Yes | No | No | No |
| cell lines | H1299 | Yes | No | No | No |
| | A549 | Yes | Yes | No | No |
| | H2052 | Yes | No | No | No |
| | HCC827 | Yes | Yes | No | No |
| LUAD | Tumor 1 | Yes | No | No | No |
| tumor | Tumor 2 | Yes | Yes | No | No |
| samples | Tumor 3 | Yes | No | No | No |
| | Tumor 4 | Yes | No | No | No |
| | Tumor 5 | Yes | No | No | No |
| | Tumor 6 | Yes | No | No | Yes |
| | Tumor 7 | Yes | No | No | No |
| | Tumor 8 | Yes | No | No | No |
| | Tumor 9 | Yes | No | No | No |
| | Tumor 10 | Yes | Yes | Yes | Yes |
| | Tumor 11 | Yes | Yes | No | No |
| | Tumor 12 | Yes | Yes | Yes | Yes |
| | Tumor 13 | Yes | Yes | No | Yes |
| | Tumor 14 | Yes | Yes | Yes | Yes |
| | Tumor 15 | No | No | No | No |

| | | TE-Exon fusion derived-peptides asociated to bind HLA-A2 Frequency | | | |
|---|---|---|---|---|---|
| | | 23 | 19 | 18 | 16 |
| | | peptide sequence | | | |
| | | YLPYFLKSL | AMDGKELSL | FLIVAEILI | RLADHLSFC |
| LUAD | H1975 | Yes | No | No | No |
| tumor | H1650 | No | No | No | Yes |
| cell lines | H1299 | No | No | No | Yes |
| | A549 | Yes | No | No | No |
| | H2052 | No | No | No | No |
| | HCC827 | Yes | yes | No | No |
| LUAD | Tumor 1 | Yes | Yes | No | Yes |
| tumor | Tumor 2 | Yes | Yes | No | No |
| samples | Tumor 3 | Yes | No | No | Yes |
| | Tumor 4 | Yes | Yes | No | No |
| | Tumor 5 | No | No | No | No |
| | Tumor 6 | Yes | Yes | Yes | Yes |
| | Tumor 7 | No | Yes | No | No |
| | Tumor 8 | Yes | Yes | No | No |
| | Tumor 9 | No | Yes | Yes | No |
| | Tumor 10 | Yes | Yes | Yes | No |
| | Tumor 11 | Yes | Yes | Yes | No |
| | Tumor 12 | Yes | Yes | No | No |
| | Tumor 13 | Yes | No | No | Yes |
| | Tumor 14 | Yes | Yes | No | Yes |
| | Tumor 15 | No | Yes | No | No |

Binding of ER-Derived Peptides to HLA-A2 Molecule

Once confirmed the expression of chimeric transcripts, the derived-peptides were synthetized and their binding to HLA-A2 was confirmed. Because monomer stabilization and tetramer formation are only possible in the presence of a high affinity binding peptide, the formation of HLA-A2 tetramers was estimated in the presence of synthetized peptides by flow cytometry. All predicted peptides were able to stabilize tetramer formation, showing a percentage of fluorescence higher than 50% relative to positive control. As positive control, a known high affinity binding peptide to HLA-A2 derived from Cytomegalovirus (CMV) was used.

Figure 10:
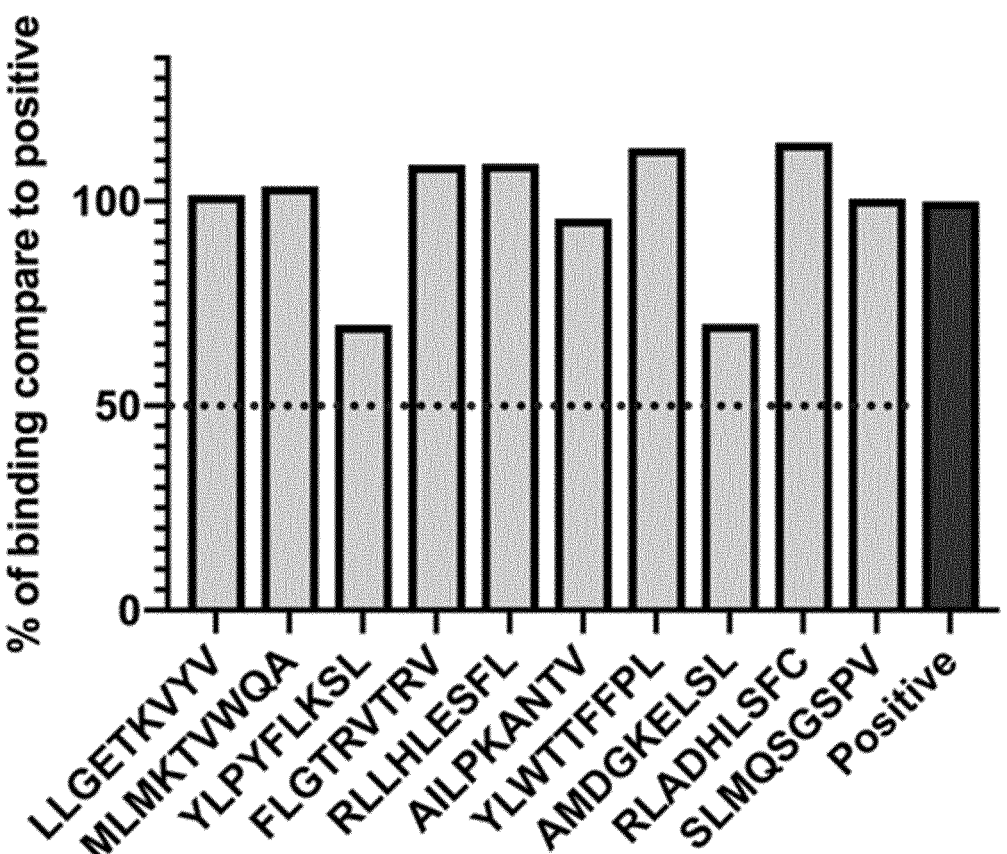
FIG. 10: Binding of chimeric transcripts-derived peptides to HLA-A2. Binding to HLA-A2 allele of predicted peptides from the most frequent chimeric fusions were validated by flow cytometry using tetramer formation assay. The results are shown as percentage of binding relative to positive control. Dotted line indicates the threshold considered to confirm the binding to this allele.

This result confirmed the predicted high affinity binding to HLA-A2 allele. FIG. 10 shows the result for 10 peptides derived from the most frequent fusions peptides.

Immunogenicity of ER-Derived Peptides

The following step after binding validation to HLA-A2 allele, was to test the immunogenicity of predicted peptides. Priming assays were thus performed to test the ability of identified peptides to expand specific cytotoxic T cells. PBMCs from HLA-A2+ healthy donors were used to generate monocyte derived-DCs (moDCs). After loading the moDCs with a mix of synthetic peptides, autologous co-culture was performed with CD4+ and CD8+ T cells.

Figures 11A, 11B, 11C, 11D:
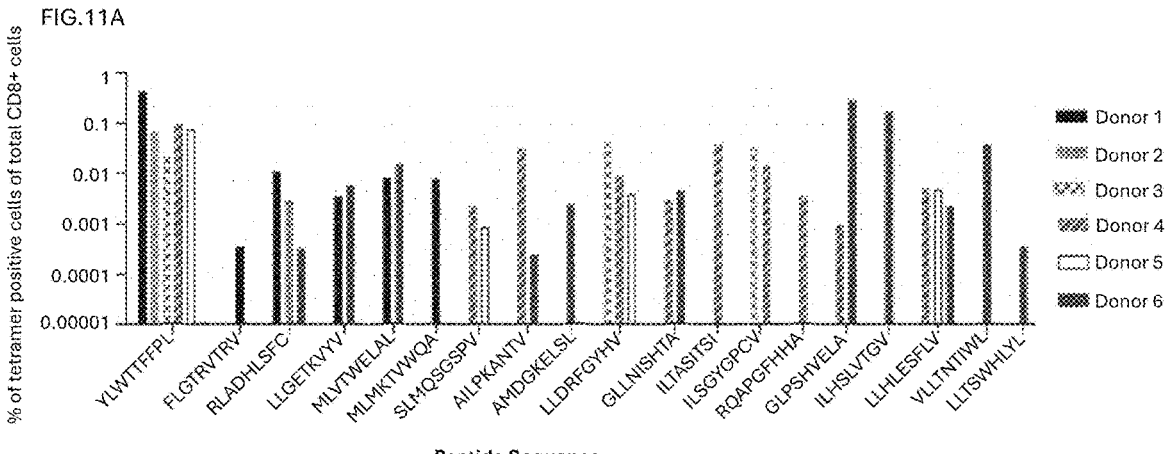
FIG. 11. Immunogenicity of fusion transcripts-derived peptides and reactive CD8+ T cells generation. (A) Percentage of tetramer positive CD8 T cells for the indicated fusion transcript-derived peptides induced by autologous moDCs in immunogenicity assays for the 6 healthy donors analyzed. (B) Cytokine secretion of CTL-clones after stimulation with different concentration of specific peptide. On the right is listed the CTL-clones generated and their peptide specificity. (C) Killing assay for CTL-clone 9 in co-culture with target cells loaded with 2 different peptide concentration in combination with anti-MHC-I antibodies or Isotype control (Left panel), or with un-loaded targets cells at different ratios (Right panel). (D) Killing assays for CTL-clone 9, 80 and 64 when co-cultured with peptide unloaded target cells in combination with anti-MHCI-I antibodies or isotype control. Effector:Target ratio is indicated in each individual plot. H1650 were used as target cells for each plot of this figure.

Finally, the expansion of specific CD8+ T cells was analysed by flow cytometry using two-colours tetramer staining. As a control of specific expansion, the co-culture was performed in the absence of peptides. By using this approach in one donor, it has been possible to identify and expand specific CD8+ T cells recognizing 6 of the most frequent chimeric fusion derived-peptides (RLLHLESFL, LLGETKVYV, AILPKANTV, RLADHLSFC, FLIVAEILI, YLWTTFFPL). This result is evidenced by an increase in at least one magnitude order of the percentage of tetramer positive cells compared to control test among total CD8+ T cells. The same experiment was performed in order to evaluate the response in additional 5 donors. FIG. 11A summarizes the results obtained for the total of 6 donors analyzed in which we found specific CD8+T expansions for 21 of the most frequent fusions transcripts-derived peptides (YLWTTFFPL, FLGTRVTRV, RLADHLSFC, LLGETKVYV, MLVTWELAL, MLMKTVWQA, SLMQSGSPV, AILPKANTV, AMDGKELSL, LLDRFGYHV, GLLNISHTA, ILTASITSI, ILSGYGPCV, RQAPGFHHA, GLPSHVELA, ILHSLVTGV, LLHLESFLV, VLLTNTIWL, LLTSWHLYL). These experiments show that these peptides are able to induce an immune response and confirms the immunogenicity of ER-derived peptides.

Generation of Cytotoxic T Lymphocytes Clones Recognizing ER-Derived Peptides

Expanded CD8+ tetramer positive T-cells from immunogenicity assays (FIG. 11A) were single cell FACS-sorted in order to generate cytotoxic T lymphocytes (CTLs) clones. We generated 10 clones recognizing 5 different ER-derived peptides: YLWTTFFPL, LLGETKVYV, MLVTWELAL, MLMKTVWQA, RLADHLSF. These peptides are listed in Table 5 as peptide 9, 86, 53, 80 and 64 respectively. We will refer to these numbers to indicate the specificity of each generated CTL-clone. Example, CTL-clone 9 recognize ER-derived peptide 9.

In order to evaluate the cytotoxic capacity of generated CTL-clones, two different functional assays were conducted using the H1650 cell line as target cells. This is a LUAD-derived tumor cell line expressing HLA-A2 allele.

First, we measure the ability of CTL-clones to secret cytokines after exposure to ER-derived peptides. After co-cultured CTL-clones with target cells loaded with the specific ER-derived peptides during 18 h, secretion of INF-γ, TNF and Granzyme-B (Gr-B) was measured in culture supernatants. All CTL-clones were activated after exposure specific ER-derived peptides, secreting cytokines in a dose-dependent manner (FIG. 11B).

In a second set of experiments, CTL clones killing capacity was assessed. CTL-clones were co-cultured in different conditions with target cells loaded or not with ER-derived peptides. Using xCELLigence system we measure the real-time impedance variation in a target cells monolayer. In these assays, a decrease in cell-index is related with a decrease in the number of cells in the monolayer reflecting cell viability.

When CTL-clone 9 was co-culture in 1:1 ratio with target cells loaded with ER-derived peptide 9, we saw a decrease in cell-index over time compared to the control cells (target cells alone). This decrease in the cell index was inhibited when co-culture is performed in presence of blocking anti-MHC-I antibody (+ anti-MHC-I). Performing the co-culture using the same concentration of isotype control (+ isotype) did not inhibit the decrease in cell-index. Moreover, these decrease increases when target cells were loaded with higher concentration of peptide (1 µM compared to 1 uM) (FIG.

11C, left panel). This result show that a cytotoxic T cell that recognizes a peptide identified by the methods disclosed herein, CTL clone 9, is killing target tumor cells.

We reasoned that if ER-derived peptides are naturally expressed and presented by target cells, we should be able to kill them by co-culturing with CTL-clones without external addition of peptides. To this aim, we performed co-culture of CTL-clone 9 with H1650 target cells at different ratios to find the one in which effectors are sufficient to kill target cells. In the right panel of FIG. 11C, we saw that CTL-9 was able to kill target cells at a ratio effector-target 4:1 compared with the control cells (target cells alone). Moreover, killing is increased at bigger ratios (8:1). No killing of target cells was evidenced at lower ratios (2:1).

Finally, similar experiments were performed with CTL-clone 9, CTL-clone 64, and CTL-clone 80 showing a specific killing of target cells that could be also inhibited when the co-culture is performed in the presence of anti-MCH-I antibodies (FIG. 11D).

All together, these results confirm that cytotoxic T cells that recognizes several different peptides identified by the methods disclosed herein are able to recognize and kill tumor cells expressing specific fusion transcripts-derived peptides and that this effect is due to the specific recognition of peptides in the context of MHC-I molecules. Moreover, the fact that CTL-clones are able to kill target cells without addition of external peptides, indicates that fusion transcripts-derived peptides 9, 64 and 80 are naturally expressed and presented by H1650 LUAD tumor cell line.

Generation of Engineered T-Cells Recognizing Fusion-Derived Peptides

Figure 12:
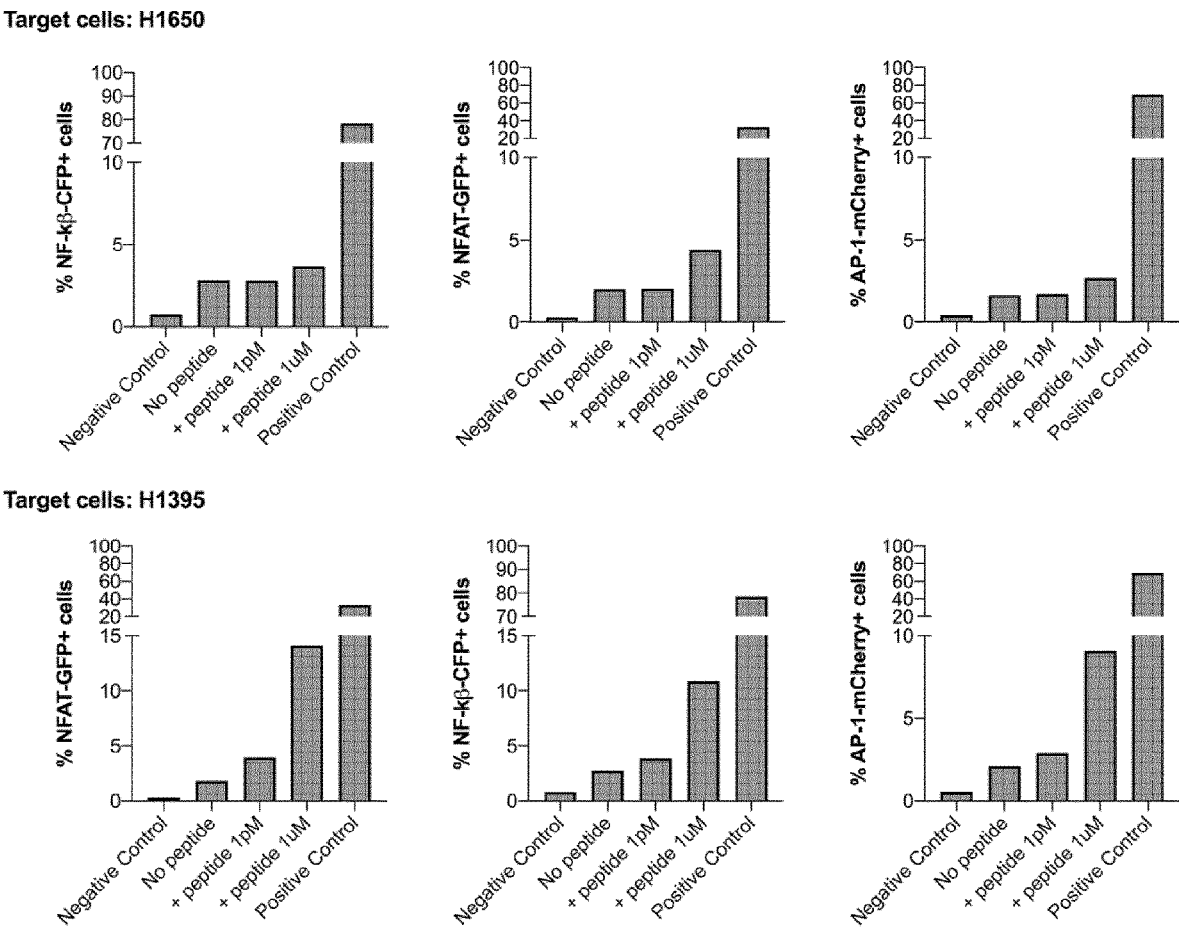
FIG. 12. Expression of TCR recognizing fusion-derived peptides. Transduced Jurkat-reporter cells with TCR sequence derived from CTL-clone 9 co-cultured with target cells alone, or loaded with 2 different peptide concentration. Plots show percentage of positive Jurkat cells for the 3 reporter genes evaluated by flow cytometry, using H1650 cell line as target cells (upper plots) or H1395 cell line as target cells (lower plots). Negative control: non-transduced Jurkat cells. No peptide: transduced Jurkat cells co-cultured with peptide unloaded target cells. Positive control: Transduced Jurkat cells stimulated with PMA/ionomycin.

Jurkat cells transduced with lentiviral vector encoding for CTL-9 TCR sequence were co-cultured with two different target cells, H1650 and H1395. Both are LUAD-derived cell lines expressing HLA-A2 allele. TCR-mediated activation of Jurkat cells was evaluated by flow cytometry analyzing an increase in the fluorescence of reporter genes (NFAT-GPF, NF-KB-CFP and AP-1-mCherry). Preliminary results show that Jurkat cells are activated when co-cultured with both target cells compared to negative control (non-transduced Jurkat cells). Furthermore, this activation increased in a dose-dependent manner when the co-culture was performed with target cells loaded with specific peptides. PMA/ionomycin was used as positive control (FIG. 12). These results are in line with the results shown in FIGS. 11 C and D, suggesting that LUAD-derived tumor cells express TE-derived peptides. Furthermore, we demonstrated the potential use of CTL-clones TCR sequences in the development of engineered T cells.

Presence of CD8+ Cells Recognizing Fusion-Derived Peptides in LUAD Patients

We aimed to identify presence of CTL cells recognizing fusion-derived peptides in LUAD tumor samples.

Figure 13A:
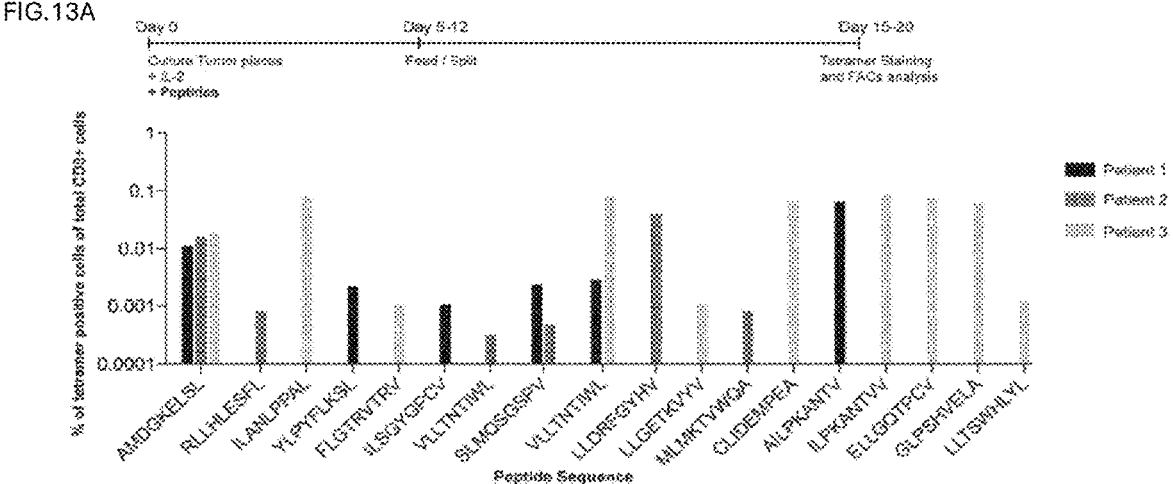
FIG. 13. Tumor infiltrating lymphocytes recognizing fusion transcripts-derived peptides. Percentage of tetramer positive CD8 T cells for the indicated fusion transcript-derived peptides found in tumor infiltrating lymphocytes (TILs) expanded in the presence of fusion transcripts-derived peptide's mix+IL2 (A) or only with IL-2 (B).
Figure 13B:
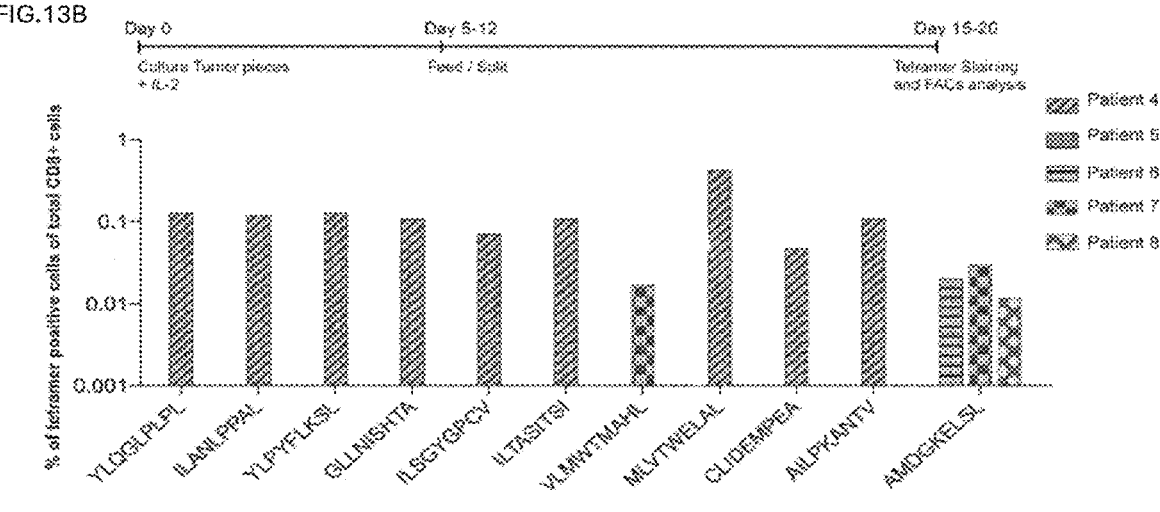

In a first set of experiments tumor infiltrating lymphocytes (TILs) expanded with a mix of TE-derived peptides and 11-2, or only with 11-2, were analyzed by tetramer staining. As is shown in FIGS. 13 A and B, we found CD8+ T-cells cells recognizing fusion-derived peptides in TILs derived from LUAD patients.

Then, we analyzed whether if we detect tetramer positive cells and their phenotype in non-expanded CD8+ T cells derived from fresh tumor samples. Using this strategy, we analyzed CD8+ T cells present in Tumor, juxta-tumor, invaded lymph-nodes and blood derived from LUAD patient samples. Phenotype was determined considering the expression of surface markers CCR7 and CD45RA as Naïve (CCR7+CD45+), Central Memory (CM, CCR7+CD45RA−)

Figures 14A, 14B:
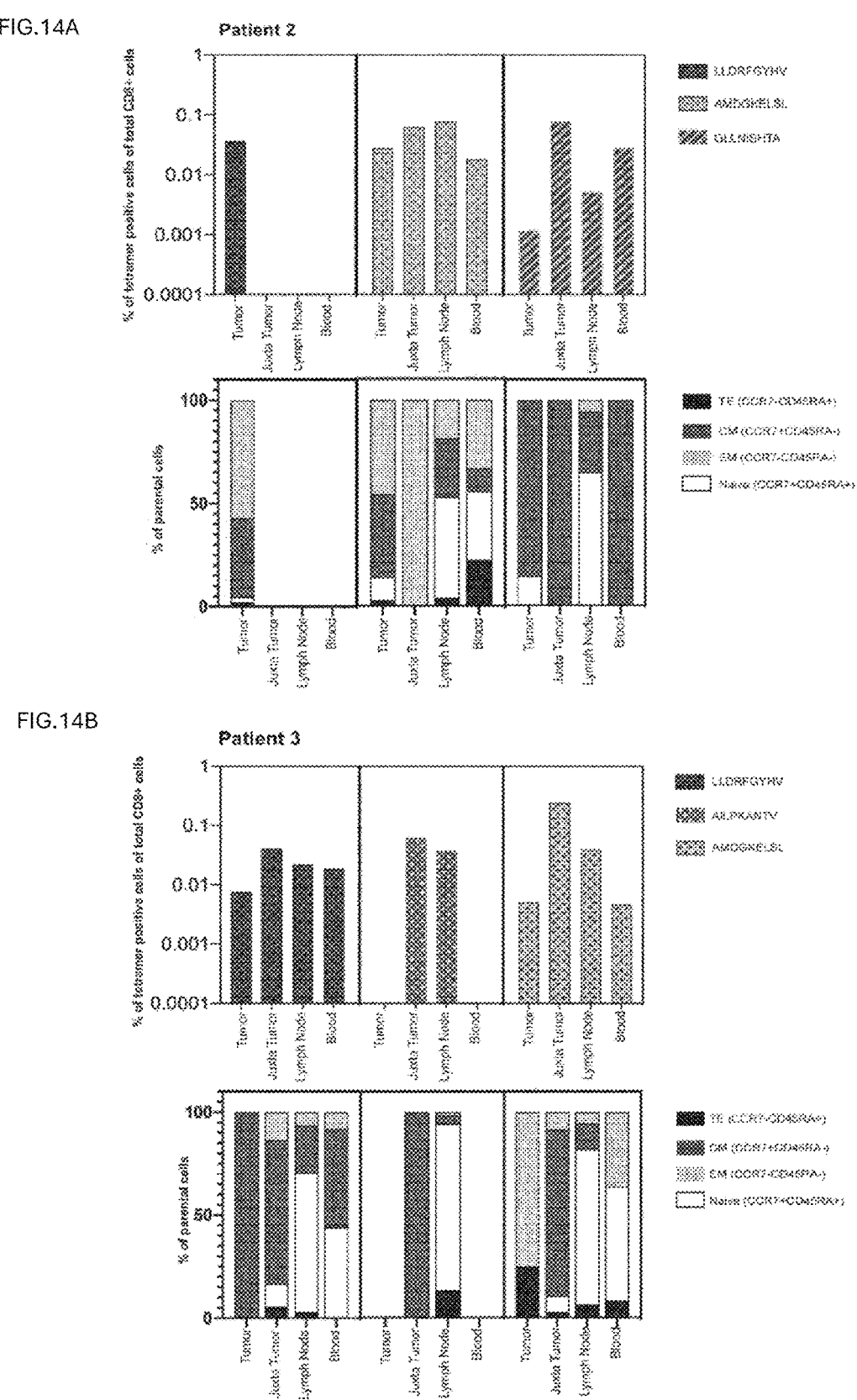
FIG. 14. Phenotype of CD8+ T cells recognizing fusion transcripts-derived peptides in LUAD patient's derived samples. Percentage of tetramer positive CD8 T cells recognizing fusion transcripts-derived peptides present in tumor, juxta tumor, lymph nodes and blood samples derived from LUAD Patient 2 (A, upper panel) and Patient 3 (B, upper panel). In lower panel of figure (A) and (B) is shown the percentage of Naïve (CCR7+CD45+), Central Memory (CM, CCR7+CD45−), Effector Memory (EM, CCR7−CD45−) and Terminal Effector (TE, CCR7−CD45+) cells of tetramer positive parental cell population.

Effector Memory (EM, CCR7−CD45−) and Terminal Effectors (TE, CCR7−CD45+). Interestingly, tetramer positive cells found in tumor tissues shared preferentially a memory phenotype whereas naïve cells (CCR7+CD45+) are found mostly cells derived from lymph nodes (FIGS. 14 A and B). Patient 2 and 3 are the same in FIG. 13 and FIG. 14.

All samples tested derived from HLA-A2+ patients.

Presence of tetramer positive cells with a memory phenotype in tumor tissues, together with the presence of tetramer positive cells in TILs, are consistent with an immune response generated against TE-derived peptides in these patients. Moreover, the existence of naïve tetramer positive cells in lymph nodes suggest the potential capacity to generate an immune response against these particularly TE-derived peptides.

Peptide Identification by Mass Spectrometry in LUAD Biopsies.

Presentation by MHC class I molecules on the tumour cell surface is required for ER-derived peptides in order to be recognized by cytotoxic T cells. In order to confirm that predicted peptides are express on MHC class I molecules, public data from MHC I immunopeptidome derived from 3 LUAD biopsies (Laumont C M et al., "Noncoding regions are the main source of targetable tumor-specific antigens" Sci Transl Med. 2018 10(470)) were used. OpenMS Software was used to analyse the raw data uploaded to PRIDE database from MHC-I immunopurification of 3 LUAD tumours (PXD009752, PXD009754 and PXD009755). Having in mind that data-dependent acquisition in proteomics only allows the identification of those sequences contained in a target database (generally the whole human proteome); the peptides as per the present application had not been previously identified because they derive from non-coding sequences. The MS/MS identifications incorporating the sequences of the herein predicted peptides in the target database has been re-analyzed. Five peptides among the 3 samples biopsies (peptides ID: 3304, 269, 757, 1810, 3953) were found. To perform this analysis, all predicted peptides derived from chimeric fusions present in at least 5 samples in the TCGA binding to any MHC I allele were considered. This result confirms the expression of chimeric fusion-derived peptides on MHC class I molecules in LUAD tumors.

Figure 15:
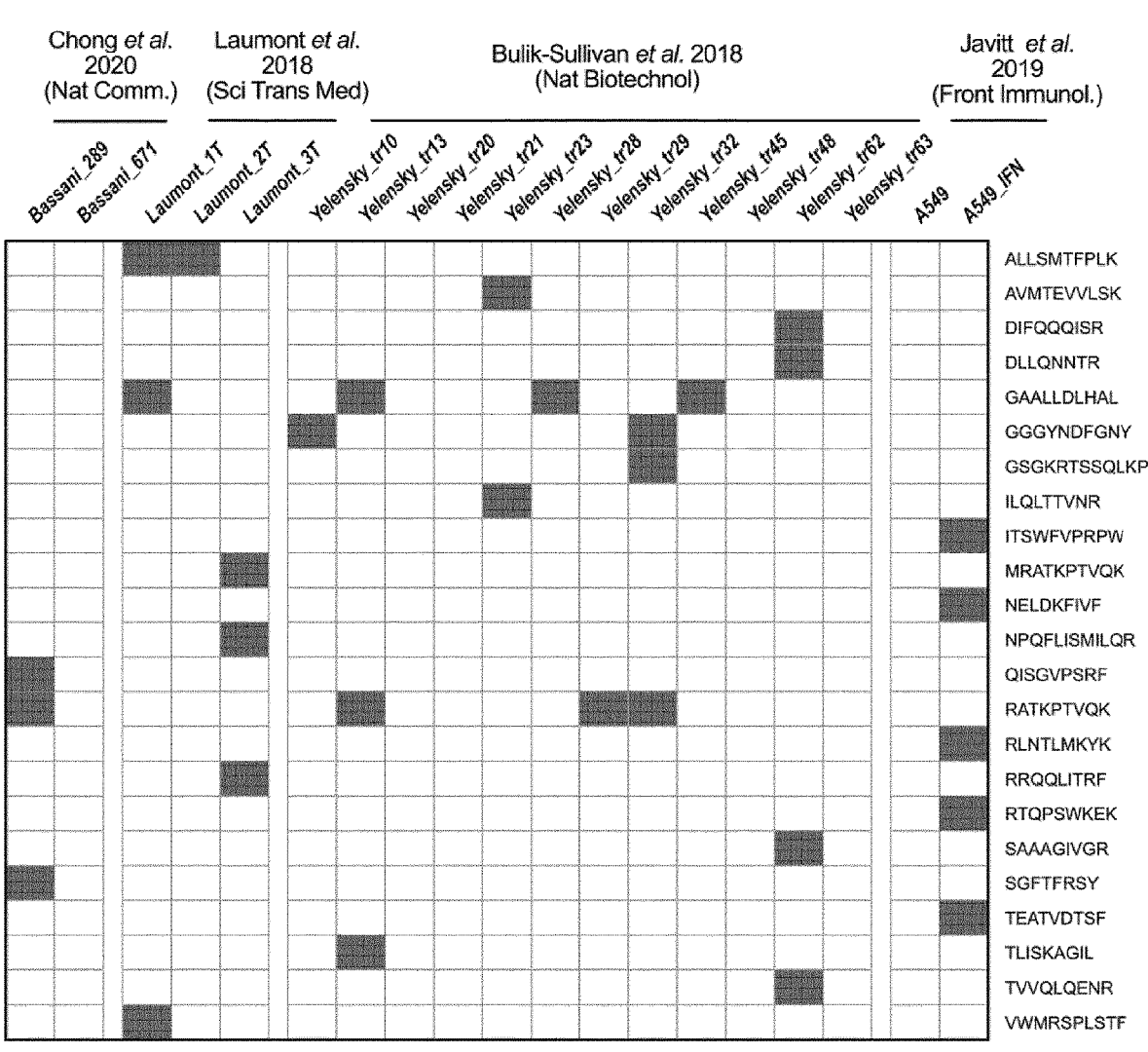
FIG. 15. Immunopeptidomics analysis of lung tumor samples. Fusion transcript-derived peptide sequences were searched in public MHC-I immunopeptidomes datasets. Each column represents a different sample. Each row represents a different peptide sequence (specify on the right). Colored squares indicate in which sample is found each fusion transcript-derived peptide. Publications describing each sample data-sets are annotated on the top.

Later, we extended our analysis to new lung immunopeptidomics datasets (Bulik-Sullivan et al. Nat. Biotec 2018, Chong et al. Nat. Comm. 2020 and Javitt et al. Front Immunol 2019). Of note, all datasets were generated with fresh lung tumor samples with the exception of Javitt et al. Front Immunol 2019 containing LUAD tumor cell line. For this second analysis, ProteomeDiscoverer 1.4 Software was used to identify the ER-derived peptides. Considering the 4 datasets, 23 unique ER-derived peptides were present in at least one of the total 19 immunopeptidomic samples. In FIG. 15, ER-derived peptides (rows) identified in each MHC sample (column) are indicated with a grey square. On the right, the peptide sequence found is indicated. Interestingly, some of them were observed in more than 1 MHC sample indicating that they are shared across samples. These results confirm that fusion transcripts-derived peptides are processed and presented by HLA-I molecules on tumor cells surface.

Peptide RLADHLSFC derived from a fusion transcript where the gene part of the fusion is a tumor suppressor gene (Fusion ID: chr22:29117506:→chr22:29115473:-/gene involved: CHEK2) and peptide GLPSHVELA derived from a fusion transcript where the gene part is an oncogene (Fusion ID: chr6:117763597:→chr6:117739669:-/gene involved: ROS1). Interestingly, both peptides were found to be immunogenic (FIG. 11 A) and particularly for peptide RLADHLSFC, results show in FIG. 11 D indicate that could be express by H1650 cell line. Furthermore, we found TILs recognizing peptide GLPSHVELA (FIG. 12A), which indicates that this fusion transcript-derived peptide could be express in LUAD tumor samples.

3 Example 3: Identification Neoantigenic Peptides Derived from Fusion Transcripts Composed of a TE Element and an Exonic Sequence from Various Cancer Samples 9184 samples from 32 different cancer types (Acute Myeloid Leukemia, Adrenocortical Carcinoma, Bladder Urothelial Carcinoma, Breast Ductal Carcinoma, Breast Lobular Carcinoma, Cervical Carcinoma, Cholangiocarcinoma, Colorectal Adenocarcinoma, Esophageal Carcinoma, Gastric Adenocarcinoma, Glioblastoma Multiforme, Head and Neck Squamous Cell Carcinoma, Hepatocellular Carcinoma, Kidney Chromophobe Carcinoma, Kidney Clear Cell Carcinoma, Kidney Papillary Cell Carcinoma, Lower Grade Glioma, Lung Adenocarcinoma, Lung Squamous Cell Carcinoma, Mesothelioma, Ovarian Serous Adenocarcinoma, Pancreatic Ductal Adenocarcinoma, Paraganglioma & Pheochromocytoma, Prostate Adenocarcinoma, Sarcoma, Skin Cutaneous Melanoma, Testicular Germ Cell Cancer, Thymoma, Thyroid Papillary Carcinoma, Uterine Carcinosarcoma, Uterine Corpus Endometrioid Carcinoma and Uveal Melanoma) were analyzed according to the method as previously described.

Fusion transcripts of SEQ ID NO: 911-17492 were identified.

In the following tables, columns will be referenced as follow:

1. Frequency in the cohort
2. Donor Chromosome Exon/2' Donor Chromosome Exon
3. Donor start Exon/3' Donor start TE
4. Donor Breakpoint Exon/4'Donor Breakpoint TE
5. Donor strand Exon/5' Donor strand TE
6. Donor transcript (i.e. Donor_tx_name_Exon)/6' Acceptor chromosome exon
7. Acceptor Chromosome TE/7' acceptor breakpoint exon
8. Acceptor Breakpoint TE/8' acceptor end exon
9. Acceptor end TE/9' acceptor strand exon
10. Acceptor strand TE/10' acceptor transcript (i.e. Acceptor_tx_name_Exon)
11. Fusion type/11' fusion type Lengthy table referenced here

US12622926-20260512-T00001

Please refer to the end of the specification for access instructions.

Lengthy table referenced here

US12622926-20260512-T00002

Please refer to the end of the specification for access instructions.

Lengthy table referenced here

US12622926-20260512-T00011

Please refer to the end of the specification for access instructions.

Lengthy table referenced here

US12622926-20260512-T00003

Please refer to the end of the specification for access instructions.

Lengthy table referenced here

US12622926-20260512-T00012

Please refer to the end of the specification for access instructions.

Lengthy table referenced here

US12622926-20260512-T00004

Please refer to the end of the specification for access instructions.

Lengthy table referenced here

US12622926-20260512-T00013

Please refer to the end of the specification for access instructions.

Lengthy table referenced here

US12622926-20260512-T00005

Please refer to the end of the specification for access instructions.

Lengthy table referenced here

US12622926-20260512-T00014

Please refer to the end of the specification for access instructions.

Lengthy table referenced here

US12622926-20260512-T00006

Please refer to the end of the specification for access instructions.

Lengthy table referenced here

US12622926-20260512-T00015

Please refer to the end of the specification for access instructions.

Lengthy table referenced here

US12622926-20260512-T00007

Please refer to the end of the specification for access instructions.

Lengthy table referenced here

US12622926-20260512-T00016

Please refer to the end of the specification for access instructions.

Lengthy table referenced here

US12622926-20260512-T00008

Please refer to the end of the specification for access instructions.

Lengthy table referenced here

US12622926-20260512-T00017

Please refer to the end of the specification for access instructions.

Lengthy table referenced here

US12622926-20260512-T00009

Please refer to the end of the specification for access instructions.

Lengthy table referenced here

US12622926-20260512-T00018

Please refer to the end of the specification for access instructions.

Lengthy table referenced here

US12622926-20260512-T00010

Please refer to the end of the specification for access instructions.

Lengthy table referenced here

US12622926-20260512-T00019

Please refer to the end of the specification for access instructions.

Lengthy table referenced here

US12622926-20260512-T00020

Please refer to the end of the specification for access instructions.

Lengthy table referenced here

US12622926-20260512-T00029

Please refer to the end of the specification for access instructions.

Lengthy table referenced here

US12622926-20260512-T00021

Please refer to the end of the specification for access instructions.

Lengthy table referenced here

US12622926-20260512-T00030

Please refer to the end of the specification for access instructions.

Lengthy table referenced here

US12622926-20260512-T00022

Please refer to the end of the specification for access instructions.

Lengthy table referenced here

US12622926-20260512-T00031

Please refer to the end of the specification for access instructions.

Lengthy table referenced here

US12622926-20260512-T00023

Please refer to the end of the specification for access instructions.

Lengthy table referenced here

US12622926-20260512-T00032

Please refer to the end of the specification for access instructions.

Lengthy table referenced here

US12622926-20260512-T00024

Please refer to the end of the specification for access instructions.

Lengthy table referenced here

US12622926-20260512-T00033

Please refer to the end of the specification for access instructions.

Lengthy table referenced here

US12622926-20260512-T00025

Please refer to the end of the specification for access instructions.

Lengthy table referenced here

US12622926-20260512-T00034

Please refer to the end of the specification for access instructions.

Lengthy table referenced here

US12622926-20260512-T00026

Please refer to the end of the specification for access instructions.

Lengthy table referenced here

US12622926-20260512-T00035

Please refer to the end of the specification for access instructions.

Lengthy table referenced here

US12622926-20260512-T00027

Please refer to the end of the specification for access instructions.

Lengthy table referenced here

US12622926-20260512-T00036

Please refer to the end of the specification for access instructions.

Lengthy table referenced here

US12622926-20260512-T00028

Please refer to the end of the specification for access instructions.

Lengthy table referenced here

US12622926-20260512-T00037

Please refer to the end of the specification for access instructions.

Lengthy table referenced here

US12622926-20260512-T00038

Please refer to the end of the specification for access instructions.

Lengthy table referenced here

US12622926-20260512-T00039

Please refer to the end of the specification for access instructions.

Lengthy table referenced here

US12622926-20260512-T00040

Please refer to the end of the specification for access instructions.

Lengthy table referenced here

US12622926-20260512-T00041

Please refer to the end of the specification for access instructions.

Lengthy table referenced here

US12622926-20260512-T00042

Please refer to the end of the specification for access instructions.

Lengthy table referenced here

US12622926-20260512-T00043

Please refer to the end of the specification for access instructions.

Lengthy table referenced here

US12622926-20260512-T00044

Please refer to the end of the specification for access instructions.

Lengthy table referenced here

US12622926-20260512-T00045

Please refer to the end of the specification for access instructions.

Lengthy table referenced here

US12622926-20260512-T00046

Please refer to the end of the specification for access instructions.

Lengthy table referenced here

US12622926-20260512-T00047

Please refer to the end of the specification for access instructions.

Lengthy table referenced here

US12622926-20260512-T00048

Please refer to the end of the specification for access instructions.

Lengthy table referenced here

US12622926-20260512-T00049

Please refer to the end of the specification for access instructions.

Lengthy table referenced here

US12622926-20260512-T00050

Please refer to the end of the specification for access instructions.

Lengthy table referenced here

US12622926-20260512-T00051

Please refer to the end of the specification for access instructions.

Lengthy table referenced here

US12622926-20260512-T00052

Please refer to the end of the specification for access instructions.

Lengthy table referenced here

US12622926-20260512-T00053

Please refer to the end of the specification for access instructions.

Lengthy table referenced here

US12622926-20260512-T00054

Please refer to the end of the specification for access instructions.

Lengthy table referenced here

US12622926-20260512-T00055

Please refer to the end of the specification for access instructions.

Lengthy table referenced here

US12622926-20260512-T00056

Please refer to the end of the specification for access instructions.

Lengthy table referenced here

US12622926-20260512-T00057

Please refer to the end of the specification for access instructions.

Lengthy table referenced here

US12622926-20260512-T00058

Please refer to the end of the specification for access instructions.

Lengthy table referenced here

US12622926-20260512-T00059

Please refer to the end of the specification for access instructions.

Lengthy table referenced here

US12622926-20260512-T00060

Please refer to the end of the specification for access instructions.

Lengthy table referenced here

US12622926-20260512-T00061

Please refer to the end of the specification for access instructions.

Lengthy table referenced here

US12622926-20260512-T00062

Please refer to the end of the specification for access instructions.

Lengthy table referenced here

US12622926-20260512-T00063

Please refer to the end of the specification for access instructions.

Lengthy table referenced here

US12622926-20260512-T00064

Please refer to the end of the specification for access instructions.

Lengthy table referenced here

US12622926-20260512-T00065

Please refer to the end of the specification for access instructions.

DESCRIPTION OF THE SEQUENCES

| SEQ ID NO | Description |
| --- | --- |
| 1-117 | LUAD peptide sequences from P1 application |
| 118-431 | Table 3 from P1 application Fusion sequences with exon donor |
| 432-910 | Table 4 from P1 application Fusion sequence with TE donor |
| 911-972 | New sequences-TCGA-ACC Fusion sequences with exon donor |
| 973-1237 | New sequences-TCGA-BLCA Fusion sequences with exon donor |
| 1238-1466 | New sequences-TCGA-BRCA Fusion sequences with exon donor |
| 1467-1632 | New sequences-TCGA-CESC Fusion sequences with exon donor |
| 1633-1696 | New sequences-TCGA-CHOL Fusion sequences with exon donor |
| 1697-1801 | New sequences-TCGA-COAD Fusion sequences with exon donor |
| 1802-1925 | New sequences-TCGA-DLBC Fusion sequences with exon donor |
| 1926-2205 | New sequences-TCGA-ESCA Fusion sequences with exon donor |
| 2206-2393 | New sequences-TCGA-GBM Fusion sequences with exon donor |
| 2394-2608 | New sequences-TCGA-HNSC Fusion sequences with exon donor |
| 2609-2721 | New sequences-TCGA-KICH Fusion sequences with exon donor |
| 2722-2890 | New sequences -TCGA-KIRC Fusion sequences with exon donor |
| 2891-2986 | New sequences-TCGA-KIRP Fusion sequences with exon donor |
| 2987-3277 | New sequences-TCGA-LGG Fusion sequences with exon donor |
| 3278-3435 | New sequences-TCGA-LIHC Fusion sequences with exon donor |
| 3436-3624 | New sequences-TCGA-LUAD Fusion sequences with exon donor |
| 3625-3946 | New sequences-TCGA-LUSC Fusion sequences with exon donor |
| 3947-4001 | New sequences-TCGA-MESO Fusion sequences with exon donor |
| 4002-4597 | New sequences-TCGA-OV Fusion sequences with exon donor |
| 4598-4660 | New sequences-TCGA-PAAD Fusion sequences with exon donor |
| 4661-4811 | New sequences-TCGA-PCPG Fusion sequences with exon donor |
| 4812-4970 | New sequences-TCGA-PRAD Fusion sequences with exon donor |
| 4971-5030 | New sequences-TCGA-READ Fusion sequences with exon donor |
| 5031-5150 | New sequences-TCGA-SARC Fusion sequences with exon donor |
| 5151-5266 | New sequences-TCGA-SKCM Fusion sequences with exon donor |
| 5267-5628 | New sequences-TCGA-STAD Fusion sequences with exon donor |
| 5629-5876 | New sequences-TCGA-TGCT Fusion sequences with exon donor |
| 5877-5979 | New sequences-TCGA-THCA Fusion sequences with exon donor |
| 5980-6119 | New sequences-TCGA-THYM Fusion sequences with exon donor |

-continued

| SEQ ID NO | Description |
|-----------|-------------|
| 6120-6190 | New sequences-TCGA-UCEC Fusion sequences with exon donor |
| 6191-6247 | New sequences-TCGA-UCS Fusion sequences with exon donor |
| 6248-6315 | New sequences-TCGA-UVM Fusion sequences with exon donor |
| 6316-6441 | New sequences-TCGA-ACC Fusion sequences with TE donor |
| 6442-6810 | New sequences-TCGA-BLCA Fusion sequences with TE donor |
| 6811-7275 | New sequences-TCGA-BRCA Fusion sequences with TE donor |
| 7276-7515 | New sequences-TCGA-CESC Fusion sequences with TE donor |
| 7516-7638 | New sequences-TCGA-CHOL Fusion sequences with TE donor |
| 7639-7817 | New sequences-TCGA-COAD Fusion sequences with TE donor |
| 7818-8055 | New sequences-TCGA-DLBC Fusion sequences with TE donor |
| 8056-8703 | New sequences-TCGA-ESCA Fusion sequences with TE donor |
| 8704-9163 | New sequences-TCGA-GBM Fusion sequences with TE donor |
| 9164-9653 | New sequences-TCGA-HNSC Fusion sequences with TE donor |
| 9654-9883 | New sequences-TCGA-KICH Fusion sequences with TE donor |
| 9884-10277 | New sequences-TCGA-KIRC Fusion sequences with TE donor |
| 10278-10454 | New sequences-TCGA-KIRP Fusion sequences with TE donor |
| 10455-11125 | New sequences-TCGA-LGG Fusion sequences with TE donor |
| 11126-11547 | New sequences-TCGA-LIHC Fusion sequences with TE donor |

-continued

| SEQ ID NO | Description |
|-----------|-------------|
| 11548-11890 | New sequences-TCGA-LUAD Fusion sequences with TE donor |
| 11891-12574 | New sequences-TCGA-LUSC Fusion sequences with TE donor |
| 12575-12698 | New sequences-TCGA-MESO Fusion sequences with TE donor |
| 12699-13750 | New sequences-TCGA-OV Fusion sequences with TE donor |
| 13751-13828 | New sequences-TCGA-PAAD Fusion sequences with TE donor |
| 13829-14029 | New sequences-TCGA-PCPG Fusion sequences with TE donor |
| 14030-14419 | New sequences-TCGA-PRAD Fusion sequences with TE donor |
| 14420-14524 | New sequences-TCGA-READ Fusion sequences with TE donor |
| 14525-14776 | New sequences-TCGA-SARC Fusion sequences with TE donor |
| 14777-15051 | New sequences-TCGA-SKCM Fusion sequences with TE donor |
| 15052-15902 | New sequences-TCGA-STAD Fusion sequences with TE donor |
| 15903-16545 | New sequences-TCGA-TGCT Fusion sequences with TE donor |
| 16546-16688 | New sequences-TCGA-THCA Fusion sequences with TE donor |
| 16689-16951 | New sequences-TCGA-THYM Fusion sequences with TE donor |
| 16952-17101 | New sequences-TCGA-UCEC Fusion sequences with TE donor |
| 17102-17261 | New sequences-TCGA-UCS Fusion sequences with TE donor |
| 17262-17492 | New sequences-TCGA-UVM Fusion sequences with TE donor |

LENGTHY TABLES

The patent contains a lengthy table section. A copy of the table is available in electronic form from the USPTO web site (https://seqdata.uspto.gov/docdetail?docId=US12622926B2). An electronic copy of the table will also be available from the USPTO upon request and payment of the fee set forth in 37 CFR 1.19(b)(3).

SEQUENCE LISTING (17496 sequences)

SEQ ID NO: 1 - protein, 9 aa, Artificial Sequence
  Synthetic peptide
RLLHLESFL

SEQ ID NO: 2 - protein, 9 aa, Artificial Sequence
  Synthetic peptide
TLMNLVQVL

SEQ ID NO: 3 - protein, 9 aa, Artificial Sequence
  Synthetic peptide
ILHSLVTGV

SEQ ID NO: 4 - protein, 9 aa, Artificial Sequence
  Synthetic peptide
FMMEQVGLA

SEQ ID NO: 5 - protein, 9 aa, Artificial Sequence
  Synthetic peptide
AMDGKELSL

SEQ ID NO: 6 - protein, 9 aa, Artificial Sequence
  Synthetic peptide
TLAYGKYYI

SEQ ID NO: 7 - protein, 9 aa, Artificial Sequence
  Synthetic peptide
GLIQLIWLA

SEQ ID NO: 8 - protein, 9 aa, Artificial Sequence
  Synthetic peptide
GMVDGGSNI

SEQ ID NO: 9 - protein, 9 aa, Artificial Sequence
  Synthetic peptide
YLWTTFFPL

SEQ ID NO: 10 - protein, 9 aa, Artificial Sequence
  Synthetic peptide
ALWEAKMII

SEQ ID NO: 11 - protein, 9 aa, Artificial Sequence
  Synthetic peptide
WLSSRVTQL

SEQ ID NO: 12 - protein, 9 aa, Artificial Sequence
  Synthetic peptide
AILPKANTV

SEQ ID NO: 13 - protein, 9 aa, Artificial Sequence
  Synthetic peptide
VLLFEVELV

SEQ ID NO: 14 - protein, 9 aa, Artificial Sequence
  Synthetic peptide
GLDTGLQGM

SEQ ID NO: 15 - protein, 9 aa, Artificial Sequence
  Synthetic peptide
SLLDGTQLF

SEQ ID NO: 16 - protein, 9 aa, Artificial Sequence
  Synthetic peptide
GLPTGYLFV

SEQ ID NO: 17 - protein, 9 aa, Artificial Sequence
  Synthetic peptide
LLDRFGYHV

SEQ ID NO: 18 - protein, 9 aa, Artificial Sequence
  Synthetic peptide
SLLEETQAI

SEQ ID NO: 19 - protein, 9 aa, Artificial Sequence
  Synthetic peptide
MLLVQPAEL

SEQ ID NO: 20 - protein, 9 aa, Artificial Sequence
  Synthetic peptide
GLLNISHTA

SEQ ID NO: 21 - protein, 9 aa, Artificial Sequence
  Synthetic peptide
HLYEPWFPV

SEQ ID NO: 22 - protein, 9 aa, Artificial Sequence
  Synthetic peptide
YLQGLPLPL

SEQ ID NO: 23 - protein, 9 aa, Artificial Sequence
  Synthetic peptide
KAVEGILAV

SEQ ID NO: 24 - protein, 9 aa, Artificial Sequence
  Synthetic peptide
MIYEENNRL

SEQ ID NO: 25 - protein, 9 aa, Artificial Sequence
  Synthetic peptide
YLPYFLKSL

SEQ ID NO: 26 - protein, 9 aa, Artificial Sequence
  Synthetic peptide
GLYSLSSVV

SEQ ID NO: 27 - protein, 9 aa, Artificial Sequence
  Synthetic peptide
LMISRTPEV

SEQ ID NO: 28 - protein, 9 aa, Artificial Sequence
  Synthetic peptide
LLGGPSVFL

SEQ ID NO: 29 - protein, 9 aa, Artificial Sequence
  Synthetic peptide
ILSGYGPCV

SEQ ID NO: 30 - protein, 9 aa, Artificial Sequence
  Synthetic peptide
FLPDLDRPL

SEQ ID NO: 31 - protein, 9 aa, Artificial Sequence
  Synthetic peptide
AMDGKELSL

SEQ ID NO: 32 - protein, 9 aa, Artificial Sequence
  Synthetic peptide
RMDFEDLGL

SEQ ID NO: 33 - protein, 9 aa, Artificial Sequence
  Synthetic peptide
TLIFNPTEI

SEQ ID NO: 34 - protein, 9 aa, Artificial Sequence
  Synthetic peptide
LLPGLLLLL

SEQ ID NO: 35 - protein, 9 aa, Artificial Sequence
  Synthetic peptide
LLLVHQHAV

SEQ ID NO: 36 - protein, 9 aa, Artificial Sequence
  Synthetic peptide
FLDDAPPGT

SEQ ID NO: 37 - protein, 9 aa, Artificial Sequence
  Synthetic peptide
VLIRYVWTL

SEQ ID NO: 38 - protein, 9 aa, Artificial Sequence
  Synthetic peptide
YLCGHLHTL

SEQ ID NO: 39 - protein, 9 aa, Artificial Sequence
  Synthetic peptide
VLSQLTILI

SEQ ID NO: 40 - protein, 9 aa, Artificial Sequence
  Synthetic peptide
TLGGLMPVL

SEQ ID NO: 41 - protein, 9 aa, Artificial Sequence
  Synthetic peptide
FLQGSITFI

SEQ ID NO: 42 - protein, 9 aa, Artificial Sequence
  Synthetic peptide
MLLLYIWQV

SEQ ID NO: 43 - protein, 9 aa, Artificial Sequence
  Synthetic peptide
YLKIMPVHL

SEQ ID NO: 44 - protein, 9 aa, Artificial Sequence
  Synthetic peptide
HTLGGLMPV

SEQ ID NO: 45 - protein, 9 aa, Artificial Sequence
  Synthetic peptide
YIMARVLFV

SEQ ID NO: 46 - protein, 9 aa, Artificial Sequence
  Synthetic peptide
FILRTDHYI

SEQ ID NO: 47 - protein, 9 aa, Artificial Sequence
  Synthetic peptide
IMSSAIAYL

SEQ ID NO: 48 - protein, 9 aa, Artificial Sequence
  Synthetic peptide
FIIGILQLA

SEQ ID NO: 49 - protein, 9 aa, Artificial Sequence
  Synthetic peptide
YLLQEIYGI

SEQ ID NO: 50 - protein, 9 aa, Artificial Sequence
  Synthetic peptide
GVFPVVIQA

SEQ ID NO: 51 - protein, 9 aa, Artificial Sequence
  Synthetic peptide
ALVHLPSQL

SEQ ID NO: 52 - protein, 9 aa, Artificial Sequence
  Synthetic peptide
GLHPAKPQV

SEQ ID NO: 53 - protein, 9 aa, Artificial Sequence
  Synthetic peptide
MLVTWELAL

SEQ ID NO: 54 - protein, 9 aa, Artificial Sequence
  Synthetic peptide
VLLTNTIWL

SEQ ID NO: 55 - protein, 9 aa, Artificial Sequence
  Synthetic peptide
ALVHLPSQL

SEQ ID NO: 56 - protein, 9 aa, Artificial Sequence
  Synthetic peptide
CLIDEMPEA

SEQ ID NO: 57 - protein, 9 aa, Artificial Sequence
  Synthetic peptide
ALMGGFMKT

SEQ ID NO: 58 - protein, 9 aa, Artificial Sequence
  Synthetic peptide
  misc_feature (8)..(8): Xaa can be any naturally occurring amino acid
LLLHLPLXL

SEQ ID NO: 59 - protein, 9 aa, Artificial Sequence
  Synthetic peptide
TLQDKNLGL

SEQ ID NO: 60 - protein, 9 aa, Artificial Sequence
  Synthetic peptide
ILANLPPAL

SEQ ID NO: 61 - protein, 9 aa, Artificial Sequence
  Synthetic peptide
PLWDGMAGL

SEQ ID NO: 62 - protein, 9 aa, Artificial Sequence
  Synthetic peptide
GLDHQTHPL

SEQ ID NO: 63 - protein, 9 aa, Artificial Sequence
  Synthetic peptide
GMFLLPPQL

SEQ ID NO: 64 - protein, 9 aa, Artificial Sequence
  Synthetic peptide
RLADHLSFC

SEQ ID NO: 65 - protein, 9 aa, Artificial Sequence
  Synthetic peptide
RMRDQLPAL

SEQ ID NO: 66 - protein, 9 aa, Artificial Sequence
  Synthetic peptide
GLLHAEVAL

SEQ ID NO: 67 - protein, 9 aa, Artificial Sequence
  Synthetic peptide
SLQNCQVSV

SEQ ID NO: 68 - protein, 9 aa, Artificial Sequence
  Synthetic peptide
VISAFPSEV

SEQ ID NO: 69 - protein, 9 aa, Artificial Sequence
  Synthetic peptide
ALAIAALEL

SEQ ID NO: 70 - protein, 9 aa, Artificial Sequence
  Synthetic peptide
VLDGLDVLL

SEQ ID NO: 71 - protein, 9 aa, Artificial Sequence
  Synthetic peptide
ELFPPLFMA

SEQ ID NO: 72 - protein, 9 aa, Artificial Sequence
  Synthetic peptide
FLIVAEILI

SEQ ID NO: 73 - protein, 9 aa, Artificial Sequence
  Synthetic peptide
IVAEILISL

SEQ ID NO: 74 - protein, 9 aa, Artificial Sequence
  Synthetic peptide
KAVEGILAV

SEQ ID NO: 75 - protein, 9 aa, Artificial Sequence
  Synthetic peptide
YLPHLPQVL

SEQ ID NO: 76 - protein, 9 aa, Artificial Sequence
  Synthetic peptide
MLLDPMGGI

SEQ ID NO: 77 - protein, 9 aa, Artificial Sequence
  Synthetic peptide
RLLHLESFL

SEQ ID NO: 78 - protein, 9 aa, Artificial Sequence
  Synthetic peptide
YLAYILYFV

SEQ ID NO: 79 - protein, 9 aa, Artificial Sequence
  Synthetic peptide
LMTSSIMSV

SEQ ID NO: 80 - protein, 9 aa, Artificial Sequence
  Synthetic peptide
MLMKTVWQA

SEQ ID NO: 81 - protein, 9 aa, Artificial Sequence
  Synthetic peptide
SLQPEDMAL

SEQ ID NO: 82 - protein, 9 aa, Artificial Sequence
  Synthetic peptide
KILTYFPMV

SEQ ID NO: 83 - protein, 9 aa, Artificial Sequence
  Synthetic peptide
FLGTRVTRV

SEQ ID NO: 84 - protein, 9 aa, Artificial Sequence
  Synthetic peptide
SLMQSGSPV

SEQ ID NO: 85 - protein, 9 aa, Artificial Sequence
  Synthetic peptide
VLMWTMAHL

SEQ ID NO: 86 - protein, 9 aa, Artificial Sequence
  Synthetic peptide
LLGETKVYV

SEQ ID NO: 87 - protein, 9 aa, Artificial Sequence
  Synthetic peptide
KILTYFPMV

SEQ ID NO: 88 - protein, 9 aa, Artificial Sequence
  Synthetic peptide
SLLERGLEA

SEQ ID NO: 89 - protein, 9 aa, Artificial Sequence
  Synthetic peptide
VLSSLNVPL

SEQ ID NO: 90 - protein, 9 aa, Artificial Sequence
  Synthetic peptide
FLERKSIRV

SEQ ID NO: 91 - protein, 9 aa, Artificial Sequence
  Synthetic peptide
FVGSSTFYL

SEQ ID NO: 92 - protein, 9 aa, Artificial Sequence
  Synthetic peptide
FLYTGDFFL

SEQ ID NO: 93 - protein, 9 aa, Artificial Sequence
  Synthetic peptide
SVGPFALTV

SEQ ID NO: 94 - protein, 9 aa, Artificial Sequence
  Synthetic peptide
NLALPLPKV

SEQ ID NO: 95 - protein, 9 aa, Artificial Sequence
  Synthetic peptide
VLESGLYQV

SEQ ID NO: 96 - protein, 9 aa, Artificial Sequence
  Synthetic peptide
MLVAITVLI

SEQ ID NO: 97 - protein, 9 aa, Artificial Sequence
  Synthetic peptide
FMDDAKILF

SEQ ID NO: 98 - protein, 9 aa, Artificial Sequence
  Synthetic peptide
ALVHLPSQL

SEQ ID NO: 99 - protein, 9 aa, Artificial Sequence
  Synthetic peptide
ILTASITSI

SEQ ID NO: 100 - protein, 9 aa, Artificial Sequence
  Synthetic peptide
AMDGKELSL

SEQ ID NO: 101 - protein, 9 aa, Artificial Sequence
  Synthetic peptide
SLGWNISGV

SEQ ID NO: 102 - protein, 9 aa, Artificial Sequence
  Synthetic peptide
MISAFPNEV

SEQ ID NO: 103 - protein, 9 aa, Artificial Sequence
  Synthetic peptide
RLTHELPGI

SEQ ID NO: 104 - protein, 9 aa, Artificial Sequence
  Synthetic peptide
LLFSDGEKV

SEQ ID NO: 105 - protein, 9 aa, Artificial Sequence
  Synthetic peptide
RLNESTTFV

SEQ ID NO: 106 - protein, 9 aa, Artificial Sequence
  Synthetic peptide
KLEELKSFV

SEQ ID NO: 107 - protein, 9 aa, Artificial Sequence
  Synthetic peptide
SINEEIQTV

SEQ ID NO: 108 - protein, 9 aa, Artificial Sequence
  Synthetic peptide
RLHDGPLRA

SEQ ID NO: 109 - protein, 9 aa, Artificial Sequence
  Synthetic peptide
MISAFPNEV

SEQ ID NO: 110 - protein, 9 aa, Artificial Sequence
  Synthetic peptide
ILHTSVPFL

SEQ ID NO: 111 - protein, 9 aa, Artificial Sequence
  Synthetic peptide
YLENMVSGV

SEQ ID NO: 112 - protein, 9 aa, Artificial Sequence
  Synthetic peptide
QLLGRLESL

SEQ ID NO: 113 - protein, 9 aa, Artificial Sequence
  Synthetic peptide
RLLHLESFL

SEQ ID NO: 114 - protein, 9 aa, Artificial Sequence
  Synthetic peptide
ALLRQMEGI

SEQ ID NO: 115 - protein, 9 aa, Artificial Sequence
  Synthetic peptide
TLNKDFQEV

SEQ ID NO: 116 - protein, 9 aa, Artificial Sequence
  Synthetic peptide
IMEQGDLSV

SEQ ID NO: 117 - protein, 9 aa, Artificial Sequence
  Synthetic peptide
RLLHLESFL

SEQ ID NO: 118 - DNA, 1199 bp, Artificial Sequence
  Synthetic polynucleotide
atgggacccccctcagcccctccctgcagattgcatgtcccctggaaggaggtcctgctcacagcctcacttctaaccttctggaacccacccaccactgccaagctcactattgaatccacgccgttcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 119 - DNA, 822 bp, Artificial Sequence
  Synthetic polynucleotide
atgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttcacattcaccatccttcaagtccgtgtgacctcattcctcttgggcactggacaaggacccagttgcgggtgcagtaggctgtcacactgactctccactgagctgtttaacacttaagttgtctgtagacagcaaagctaaaacagcacactgtaacacatgccctctggggctctagaggctgtggacagcccctagacgctgctgtgggctggtaaggagtttattcctgctggtgcccaaaggcactcaccccagctcctgcacccactcacctacatcttccccctctttcaaggggtttgagcactgcaggctgagtaagcgagccagcgcttcacaagccccatggggtcaagggaacccatctca

SEQ ID NO: 120 - DNA, 3992 bp, Artificial Sequence
  Synthetic polynucleotide
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgaaagggactctcgctgggcctcaatttcctcatctgtgaactgg

SEQ ID NO: 121 - DNA, 3845 bp, Artificial Sequence
  Synthetic polynucleotide
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgaaagggactctcgctgggcctcaatttcctcatctgtgaactgg

SEQ ID NO: 122 - DNA, 1221 bp, Artificial Sequence
  Synthetic polynucleotide
atggagagaaaaataagcagaatccaccttgtttctgaacccagtataactcattttctacaagtatcttgggagaaaacactggaatctggttttgttattacacttactgatggtcattcagcatggactgggacagtttctgaatcagagatttcccaagaagctgatgacatggcaatggaaaaagggaaatatgttggtgaactgagaaaagcattgttgtcaggagcaggaccagctgatgtatacacgtttaatttttctaaagagtcttgttatttcttctttgagaaaaacctgaaagatgtctcattcagacttggttccttcaacctagagaaagttgaaaacccagctgaagtcattagagaacttatttgttattgcttggacaccattgcagaaaatcaagccaaaaatgagcacctgcagaaagaaaatgaaaggcttctgagagattggaatgatgttcaaggacgatttgaaaaatgtgtgagtgctaaggaagctttggagactgatctttataagcggtttattctggtgttgaatgagaagaaaacaaaaatcagaagtttgcataataaattattaaatgcagctcaagaacgagaaaaggacatcaaacaagaaggggaaactgcaatctgttctgaaatgactgctgaccgagatccagtctatgatgagagtactgatgaggaaagtgaaaaccaaactgatctctctgggttggcttcagctgctgtaagtaaagatgattccattatttcaagtcttgatgtcactgatattgcaccaagtagaaaaaggagacagcgaatgcaaagaaatcttgggacagaacctaaaatggctcctcaggagaatcagcttcaagaaaaggaaaaagggaggaagaaggagacttcagagaaagaggccgtgtgatggaagcaaaatcagagagaaaagatgctaagctgctgcctttgaataaggaggaacgtgagccaacagatccaagaactgaagctctaggcagtggaaaagccaaggaaactgatcttcccttcgagcctccggagggagtgtagccctgccaacacctttattttagccccataacagtcatttcagacttgtggcctccagaattttaagagaataaatttttattgtattaagccatcaagtttgtggtagtttgtggtaatttagccataagaaactaataca

SEQ ID NO: 123 - DNA, 1221 bp, Artificial Sequence; identical to SEQ ID NO: 122
  Synthetic polynucleotide

SEQ ID NO: 124 - DNA, 1221 bp, Artificial Sequence; identical to SEQ ID NO: 122
  Synthetic polynucleotide

SEQ ID NO: 125 - DNA, 1221 bp, Artificial Sequence; identical to SEQ ID NO: 122
  Synthetic polynucleotide

SEQ ID NO: 126 - DNA, 1833 bp, Artificial Sequence
  Synthetic polynucleotide
atgggagagagagttcgcatcaaatttggtgactttgacattgaagattctgattcttgtcactttaattacttgagaatttataatggaattggagtcagcagaactgaaataggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggtaatttatagattcaatgccatccccatcaagctaccaatgactttcttcacagaattggaaaaaactactttaaagttcatatggaaccaaaaaagagctggcattgccaagtcaatcctaagccaaaagaacaaagcgggaggcatcaggctacctgacttcaaactatactacaaggctacagtaaccaaaacagcatggtactgggaccaaaacagagatatagaccaatggaacagaacagagccctcagaaataataccacacatctacaaccatctgatctttgacaaacctgacaaaaacaagaaatggggaaaggattccctatttaataaatggttctgggaaaactggctagccatatgtaaaaagctgaaactggatcccttccttacaccttatgcaaaaactaattcaagatggattaaagacttaaatgttagacctaaaaccataaaaaccctagaagaaaacctaggcagtaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcagacaaagggctaatattgagaatctacaaagaactcaaacaaatttacaagaaaaaaacaaccccatcaacaagtgggcaaatgatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaataacaggtgctggagaggttgtggagaaataggaacacttttacactgttggtgggagtgtaaactagttcaaccattgtggaagacagtgtggcgattcctcagggatctagaactagaaataccatttgacccagccatcccattactgggtatatacccaaaggattataaatcatgctgctataaagacacatgcacacgtctgtttattgcggcactattcacaatagcaaagacttggaaccaacccagatgtccatcaatgatagactggattaagaaaatgtggcacatatacaccatggaatactatgcagccataaaaaatgatgagttcatgtcctttgtaaggacatggatgaagctggaaaccatcattctcagcaaactatcacaaggacaaaaaaccgaacaccgcatgttctcactcataggtgggaattgaacaatgagaacagttggacacaggaaggggaacatcacacaccggtgcctgtcatggggtggggggagggaggagggatagcattaggagatatacctaatgtaaatgacgagttaatgggtgcagcacaccagcgtgtcacatgtatacatatgtcacctgcacgttgtgcacatgtaccctagaacttaaagtataatacaaaa

SEQ ID NO: 127 - DNA, 2151 bp, Artificial Sequence
  Synthetic polynucleotide
atggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggtaatttatagattcaatgccatccccatcaagctaccaatgactttcttcacagaattggaaaaaactactttaaagttcatatggaaccaaaaaagagctggcattgccaagtcaatcctaagccaaaagaacaaagcgggaggcatcaggctacctgacttcaaactatactacaaggctacagtaaccaaaacagcatggtactgggaccaaaacagagatatagaccaatggaacagaacagagccctcagaaataataccacacatctacaaccatctgatctttgacaaacctgacaaaaacaagaaatggggaaaggattccctatttaataaatggttctgggaaaactggctagccatatgtaaaaagctgaaactggatcccttccttacaccttatgcaaaaactaattcaagatggattaaagacttaaatgttagacctaaaaccataaaaaccctagaagaaaacctaggcagtaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcagacaaagggctaatattgagaatctacaaagaactcaaacaaatttacaagaaaaaaacaaccccatcaacaagtgggcaaatgatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaataacaggtgctggagaggttgtggagaaataggaacacttttacactgttggtgggagtgtaaactagttcaaccattgtggaagacagtgtggcgattcctcagggatctagaactagaaataccatttgacccagccatcccattactgggtatatacccaaaggattataaatcatgctgctataaagacacatgcacacgtctgtttattgcggcactattcacaatagcaaagacttggaaccaacccagatgtccatcaatgatagactggattaagaaaatgtggcacatatacaccatggaatactatgcagccataaaaaatgatgagttcatgtcctttgtaaggacatggatgaagctggaaaccatcattctcagcaaactatcacaaggacaaaaaaccgaacaccgcatgttctcactcataggtgggaattgaacaatgagaacagttggacacaggaaggggaacatcacacaccggtgcctgtcatggggtggggggagggaggagggatagcattaggagatatacctaatgtaaatgacgagttaatgggtgcagcacaccagcgtgtcacatgtatacatatgtcacctgcacgttgtgcacatgtaccctagaacttaaagtataatacaaaa

SEQ ID NO: 128 - DNA, 2151 bp, Artificial Sequence; identical to SEQ ID NO: 127
  Synthetic polynucleotide

SEQ ID NO: 129 - DNA, 1239 bp, Artificial Sequence
  Synthetic polynucleotide
atgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 130 - DNA, 1200 bp, Artificial Sequence
  Synthetic polynucleotide
atggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagagttgtgctaatggtattttccctggtatctgtcacctatggggccaccctttgcaatatgttggctatccagatcaagtacgatgactacaagattcgccttgggccactagaagtcctctgcatcaccatctggcggacattggagatcacttcccgcctcctgattctggtgctcttctcagccactttgaaattgaaggctgtgcccttcctagtgctcaacttcctgatcatcctctttgagccctggattaagttctggagaagtggtgcccagatgcccaataacattgagaaaaacttcagccgggtcggcactctggtggtcctgatttcagtcaccatcctctatgctggcatcaacttctcttgctggtcagctttgcagttgaggttggcagacagagatctcgtcgacaaagggcagaactggggacatatgggcctgcactatagtgtgaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 131 - DNA, 776 bp, Artificial Sequence
  Synthetic polynucleotide
atgaacacaagaccacaacattcagaaagaacctcgacaatggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 132 - DNA, 737 bp, Artificial Sequence
  Synthetic polynucleotide
atggacagagtttatgaaattcctgaggagccaaatgtggatccggtttcatctctggaggaagatgtcatccgtggagccaacccccgatttacttttccatttagcatccttttctccacctttttgtactgtggggaggctgcatctgctttgtacatggttagaatctatcgaaagaatagtgaaacttactggatgacatacaccttttctttctttatgttttcatccattatggtccagttgaccctcatttttgtccacagagatctagccaaagataaaccgctatcattatttatgcatctaatcctcttgggacctgttatcagatgtttggaggccatgattaagtacctcacactgtggaagaaagaggagcaggaggagccctatgtcagcctcacccgaaagaagatgctaatagatggcgaggaggtgctgatagaatgggaggtgggccactccatccggaccctggctatgcaccgcaatgcctacaaacgtatgtcacagatccaagccttcctgggctcagtgccccagctgacctatcagctctatgtgagcctgatctctgcagaggttcccctgggtagaggtcctttgtacatggcaagtctttctgtctagaaccctaaagaagcctggctgttcccgtctcagcatacacatgttatctcatatgccaccttctcaaaaaggacttccctgatcactctatttaaaatagc

SEQ ID NO: 133 - DNA, 1834 bp, Artificial Sequence
  Synthetic polynucleotide
atggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggtagtatcggctcatactgctaaacattgcaaagaattttgggttattactgcttcatttatctcaaaggttattaatatagttggtagtgtaaaggaagtagaactcatacctactttggaatggctatcagaaagaagacattactatttattacggcaattcaagatattttctgatttccggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcctatgcctgtctttactttaatctcttaatcccgtcatcttcgtaagctgaggaggatgtatgtcacctcaggaccctgtgttgattgcgttaactgcacagattgtgtgtagagcatgtgtgtttgaacaatatgaaatctgggcaccttgaaagaagaacaggataacagcaatgttcagggaacaagagagataaccttaaattctgaccactgatgagctggaacagagccatatttctctttcaaaagcaaatgggagaaatatctctgaattctttttctcagcaaggaacatccctgagaaagagaatgcgtccctgagggtaggcctctgaaatggccgcttcggggggcggctgtattttatggtcaaagctgtagggatgaaataagccccagtcccgtaacgctcccaggcttattaggacgaggaaattcccgcctaataaattttggtgagaccggttgtctgctctcaaaccctgtcttctgataagatgttatcagtgacaatgcgtgcccgaaacttcattggcaattttaatttcgccccggtcctgtggtcctgtgatgttgccctgcctccatttgccttgtgatatcttattaccttgtgaagcatgtgatctctgtgacccacaccctattcgtacactccctccccttttgaaaatcactaataaaaacttgctggttttaccgctcgggggcatgatggaacctgccgacatgtgatgtctgccccggacacccagctttaaaatttctctcttttgtatgctgtccctttatttctcagactggccgacacttagggaatatagaaaagaacctacgtgaaatattgggggtgaattttgcccgata

SEQ ID NO: 134 - DNA, 1834 bp, Artificial Sequence; identical to SEQ ID NO: 133
  Synthetic polynucleotide

SEQ ID NO: 135 - DNA, 1765 bp, Artificial Sequence
  Synthetic polynucleotide
atggagacgtttatacccattgatttgacaactgaaaatcaagagatggacaaggaggaaaccaagacaaaaccaagacttttaagatatgaagagaaaaaatatgaagatgtgaaaccattagagactcaaccagctgaaatagcagaaaaggaaacattggaatataaaacagttagaacattctctgaatctttgaagtcagagaaaacagaagattaccttagagaaagtataattcaacaacatatggtttctccagagccagcttcccttaaggagaaagggaagtcaaggagaaaaaaggatcaaactcatgcttgtccaaatgttaggaaagccaggcctgtgtcctatgatagaacagaaccaaaagatgatgatgtgataagaaatattattaggctacgagaaaagcttggttggcaaactatattaccgcagcacagtttgaaatacggaagctccaaaattgcaattcagaagattactttaaagaaacctttggaagatgatggagaatttgtttattgccttcctcggaaaagtcctaaatccctttacaatccatatgatcttcaggttattaatatagttggtagtgtaaaggaagtagaactcatacctactttggaatggctatcagaaagaagacattactatttattacggcaattcaagatattttctgatttccggaagtcagggaccccgaacggagggaccggccgaagccatggcagaagaacgtggattgtgaagatttcatgaacatttattagttccccaaattaatacttttataatttcttacacctgtctttactgcagtctccgaacataaattgtgaagatttcatggatacttatcacaataaatacccttgtgatttcctatgcctgtctttactttaatctcttaatcccgtcatcttcgtaagctgaggaggatgtatgtcacctcaggaccctgtgttgattgcgttaactgcacagattgtgtgtagagcatgtgtgtttgaacaatatgaaatctgggcaccttgaaagaagaacaggataacagcaatgttcagggaacaagagagataaccttaaattctgaccactgatgagctggaacagagccatatttctctttcaaaagcaaatgggagaaatatctctgaattctttttctcagcaaggaacatccctgagaaagagaatgcgtccctgagggtaggcctctgaaatggccgcttcggggggcggctgtattttatggtcaaagctgtagggatgaaataagccccagtcccgtaacgctcccaggcttattaggacgaggaaattcccgcctaataaattttggtgagaccggttgtctgctctcaaaccctgtcttctgataagatgttatcagtgacaatgcgtgcccgaaacttcattggcaattttaatttcgccccggtcctgtggtcctgtgatgttgccctgcctccatttgccttgtgatatcttattaccttgtgaagcatgtgatctctgtgacccacaccctattcgtacactccctccccttttgaaaatcactaataaaaacttgctggttttaccgctcgggggcatgatggaacctgccgacatgtgatgtctgccccggacacccagctttaaaatttctctcttttgtatgctgtccctttatttctcagactggccgacacttagggaatatagaaaagaacctacgtgaaatattgggggtgaattttgcccgata

SEQ ID NO: 136 - DNA, 1834 bp, Artificial Sequence; identical to SEQ ID NO: 133
  Synthetic polynucleotide

SEQ ID NO: 137 - DNA, 645 bp, Artificial Sequence
  Synthetic polynucleotide
atgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggaaaccaacaatcaggcctcccacatagatcaaggaattgaaacttaccagatcacttcatctggacaatgagatactagacaccttacccatcatgagtgcctaagcgaccacctgctattgggttaccagctcctcttccatatccctccctaattcctgttttcccacacatgattacatttctttccagctatacaaactcttaattttagtacattagggagatggatttgagactgacctcccttctccacagctgcaacaaccaattaaaggcttcttccctggcaatacttgttcgtctcagtgattggctttctgtgcagcaagcaacaggacctagaccaaacccctggcattgtgataaca

SEQ ID NO: 138 - DNA, 645 bp, Artificial Sequence; identical to SEQ ID NO: 137
  Synthetic polynucleotide

SEQ ID NO: 139 - DNA, 980 bp, Artificial Sequence
  Synthetic polynucleotide
atgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaa

SEQ ID NO: 140 - DNA, 1256 bp, Artificial Sequence
  Synthetic polynucleotide
atggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaa

SEQ ID NO: 141 - DNA, 1256 bp, Artificial Sequence; identical to SEQ ID NO: 140
  Synthetic polynucleotide

SEQ ID NO: 142 - DNA, 1277 bp, Artificial Sequence
  Synthetic polynucleotide
atggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcagttacctcatataagtcaaatcgtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggcatggtggtgagcatctgtaatcccagctactcagaggctgaggtaggagaatcgcttgaacctgggaggcagaggtgagtcaagattgtaccaatggattccaaactgggcaacagagtgagactcggtctcaaaataaaaaa

SEQ ID NO: 143 - DNA, 1256 bp, Artificial Sequence; identical to SEQ ID NO: 140
  Synthetic polynucleotide

SEQ ID NO: 144 - DNA, 128 bp, Artificial Sequence
  Synthetic polynucleotide
atgctcaggtgtgacctacacatgtgacttcacctcagttttgtgatccgtaaaatggacaaattcgaagctacttcacagtgctgttgagaggattaaatgaaacaatgcttgtaaagctctttgca

SEQ ID NO: 145 - DNA, 690 bp, Artificial Sequence
  Synthetic polynucleotide
atggaggagccgcagcgcgcccgctcgcacacagtcaccaccaccgccagctccttcgcagagaacttctccaccagcagcagcagcttcgcctacgaccgggagttcctccgcaccctgcccggcttcctcatcgtggccgagatcctgatttccctgcctataaccgaccccctacaccggtctgctctcagcacaacagccagagatatcctggtaagatgtgtcatgatattccacttcccattgcatttggagtgagagagccagtctgttcagtttcagtctgcaagaccccatgggttcctcccttacctctctgaccttatatcctgcgctccactcctgggtgagctgctctggcccccttgctgcttttgtgacacagcaagcatgctccagctctaggtgtttgtattttctcttctccctgcctagaacccactttctccaggtcttatttcagcacctcctttccctgaacattctgtgtaataagttaacccttatctccttagcctgcctagtatttttccatagcatttgttaccatctgatgtatgtactgtttttttggtctgatgcttccactagaacatgagttatgtgagagtagaaactgtatttttcattgctgtatccctagtacttaaattgcacataacacgcactaaataaatgttgaaagaa

SEQ ID NO: 146 - DNA, 690 bp, Artificial Sequence; identical to SEQ ID NO: 145
  Synthetic polynucleotide

SEQ ID NO: 147 - DNA, 301 bp, Artificial Sequence
  Synthetic polynucleotide
ggcgacgagtcagtatttcgacttcgcgcagggcggcggcccgcagtacaggcccgccatgaccagcccgtgagaaagtgcaaccccctgctcacacccccttgccgcgtccttcccggcggcatgagaaccatcagatcgcgttgaattattttgctgaccccgtgtctccctggactatcgcgcagcaccctcctggaggacgggactttggtctggttattccccgctgctgtgacagcgcccatgacagcagctggtccccactagcacccaggaagtatttatccaatgactcaat

SEQ ID NO: 148 - DNA, 303 bp, Artificial Sequence
  Synthetic polynucleotide
atggcgacgagtcagtatttcgacttcgcgcagggcggcggcccgcagtacaggcccgccatgaccagcccgtgagaaagtgcaaccccctgctcacacccccttgccgcgtccttcccggcggcatgagaaccatcagatcgcgttgaattattttgctgaccccgtgtctccctggactatcgcgcagcaccctcctggaggacgggactttggtctggttattccccgctgctgtgacagcgcccatgacagcagctggtccccactagcacccaggaagtatttatccaatgactcaat

SEQ ID NO: 149 - DNA, 303 bp, Artificial Sequence; identical to SEQ ID NO: 148
  Synthetic polynucleotide

SEQ ID NO: 150 - DNA, 303 bp, Artificial Sequence; identical to SEQ ID NO: 148
  Synthetic polynucleotide

SEQ ID NO: 151 - DNA, 303 bp, Artificial Sequence; identical to SEQ ID NO: 148
  Synthetic polynucleotide

SEQ ID NO: 152 - DNA, 803 bp, Artificial Sequence
  Synthetic polynucleotide
atggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgccagtcctccatccttctgctgggaacttggatgctagagctcttgcagtcacactgggccatgaagataaaggtcaccccctaggaatgatagagcagaaagctggaaggaacctgggtccctgatctctgtggagccactgaactgcctctaatgaaggaaaacatttctctcatttatgctgcatgttcttttcgattttatgttatatttagtggagtataatcctaatttgataca

SEQ ID NO: 153 - DNA, 1094 bp, Artificial Sequence
  Synthetic polynucleotide
atggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcagatcctgcagaaaaaagaaacaaatttgatactcacaatgacttggatggactcccagtgaaaaaagcctatcccaaaaggttatgtactttctgattccatgtatagaacatcctcaaaatgacaaaattctatcatgcaaaacagatactgttggatggggtggggcggggcaggagggcagtgggcgtggctataaagagcagcctgaggggtcctggtggtgatggaaagcttctttatttcactgtatcaatgtcaattgttgactttgatattgttctatagttttgcaatatattactgttaagagaaactgagtcagtggcgttcttacaactgcatgtgaatctccaattagccccaaattaaaagttta

SEQ ID NO: 154 - DNA, 423 bp, Artificial Sequence
  Synthetic polynucleotide
atgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgcacagtgactgaaacatcacaagcaataagtaatgactaaatgaatgaat

SEQ ID NO: 155 - DNA, 423 bp, Artificial Sequence; identical to SEQ ID NO: 154
  Synthetic polynucleotide

SEQ ID NO: 156 - DNA, 1736 bp, Artificial Sequence
  Synthetic polynucleotide
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggaaaaaaaaaaaa

SEQ ID NO: 157 - DNA, 1724 bp, Artificial Sequence
  Synthetic polynucleotide
atggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggaaaaaaaaaaaa

SEQ ID NO: 158 - DNA, 3825 bp, Artificial Sequence
  Synthetic polynucleotide
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagtgtgtatcagccagatggcagtgtgttacagtt

SEQ ID NO: 159 - DNA, 572 bp, Artificial Sequence
  Synthetic polynucleotide
atggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtggtctcagtgtgaagatcaaaatagcctgcttgacgatgttgtttaaatcagacacccacccctattgttattctgaatgagagacacctacctgtattatcttcagagcaatgatcacagatcggtcatgattcaagtttttgtttgtttcattgtctcctaactggtaaaatccatacgcgcccatttcagttcatatttatcttcatacctgttgggcctaacatcgttcctgatatatagtgggtgttctataaatatttactgaatgaataagt

SEQ ID NO: 160 - DNA, 572 bp, Artificial Sequence; identical to SEQ ID NO: 159
  Synthetic polynucleotide

SEQ ID NO: 161 - DNA, 572 bp, Artificial Sequence; identical to SEQ ID NO: 159
  Synthetic polynucleotide

SEQ ID NO: 162 - DNA, 118 bp, Artificial Sequence
  Synthetic polynucleotide
ctcactttcggcggagggaccaaggtggagatcaaacgaagtggaatctatttctccacctccttgaatctagactgacattttgccttgccgtgagcaatagaagtggtagcagaag

SEQ ID NO: 163 - DNA, 610 bp, Artificial Sequence
  Synthetic polynucleotide
atggcaaatatgaatagtgattctaggcatcttggcacctctgaggtagatcatgaaagagatcctggacctatgaatatccagtttgagccatcggatctaagatccaaaagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgccccgccgccatcccatctgggaagtgaggagcgcctcttcccggccaccatcacatctaggaagtgaggagcgtctctgccccgctgcccatcgtctgggatgtggggagcgcctctgccccgccgcctcgtctgggatgtgaggagcgcctctgcccggccgccaccccgtctgggaggtgaggagcgtctctgcccggccgccccgtctgagaagagaggagaccctccgcccggcagccgccccgtatgagaagtgaggagcctctccacccggcagccaccccgtctgggaagtgaggagcgtctccgcccggcagccaccccgtccgggagg

SEQ ID NO: 164 - DNA, 610 bp, Artificial Sequence; identical to SEQ ID NO: 163
  Synthetic polynucleotide

SEQ ID NO: 165 - DNA, 610 bp, Artificial Sequence; identical to SEQ ID NO: 163
  Synthetic polynucleotide

SEQ ID NO: 166 - DNA, 610 bp, Artificial Sequence; identical to SEQ ID NO: 163
  Synthetic polynucleotide

SEQ ID NO: 167 - DNA, 610 bp, Artificial Sequence; identical to SEQ ID NO: 163
  Synthetic polynucleotide

SEQ ID NO: 168 - DNA, 610 bp, Artificial Sequence; identical to SEQ ID NO: 163
  Synthetic polynucleotide

SEQ ID NO: 169 - DNA, 610 bp, Artificial Sequence; identical to SEQ ID NO: 163
  Synthetic polynucleotide

SEQ ID NO: 170 - DNA, 610 bp, Artificial Sequence; identical to SEQ ID NO: 163
  Synthetic polynucleotide

SEQ ID NO: 171 - DNA, 610 bp, Artificial Sequence; identical to SEQ ID NO: 163
  Synthetic polynucleotide

SEQ ID NO: 172 - DNA, 610 bp, Artificial Sequence; identical to SEQ ID NO: 163
  Synthetic polynucleotide

SEQ ID NO: 173 - DNA, 103 bp, Artificial Sequence
  Synthetic polynucleotide
atgatgtcacagtcatctggatcaggagatgggaatgatgatgaggctactacctctaaagacggtggcctactgaacatcagtcacacagcatggtaatatg

SEQ ID NO: 174 - DNA, 681 bp, Artificial Sequence
  Synthetic polynucleotide
atggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggatgatgatgata

SEQ ID NO: 175 - DNA, 1520 bp, Artificial Sequence
  Synthetic polynucleotide
atgccgatggatttgattttagttgtgtggttctgtgtgtgcactgccaggacagcagaagatatgaagccacccgtgttatcgctgatatggagaactagagttctgaagtctctgcttcagcaatcccttcagggagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaaggggaaggagggagtgctcctggcatctgatgggtagaggccaccaatgctgctgaacattctacaagcacaagagaagctcccaacaacaacaaatgatctgatctcaaatcccaatactgctgtggttgagacac

SEQ ID NO: 176 - DNA, 1436 bp, Artificial Sequence
  Synthetic polynucleotide
atgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaaggggaaggagggagtgctcctggcatctgatgggtagaggccaccaatgctgctgaacattctacaagcacaagagaagctcccaacaacaacaaatgatctgatctcaaatcccaatactgctgtggttgagacac

SEQ ID NO: 177 - DNA, 1265 bp, Artificial Sequence
  Synthetic polynucleotide
atgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaaggggaaggagggagtgctcctggcatctgatgggtagaggccaccaatgctgctgaacattctacaagcacaagagaagctcccaacaacaacaaatgatctgatctcaaatcccaatactgctgtggttgagacac

SEQ ID NO: 178 - DNA, 1436 bp, Artificial Sequence; identical to SEQ ID NO: 176
  Synthetic polynucleotide

SEQ ID NO: 179 - DNA, 423 bp, Artificial Sequence
  Synthetic polynucleotide
atgagtatcaatgggaaattacaagatgggtcaatggaaatagacgctgggaacaacttggagacctttaaaatgggaagtggagctgaagaagcaattgcagttaatgatttccagaatggacatggatgaagctggaaaccatcattctcagcaaactatcgcaaggacaaaaaagcaaacaccgcatgttctcactcataggtgggaattgaacaatgagaacacatggatacaggaaggggaacgtcacacaccaggaactgctgtggggtggggggagggatagcatgaggagatatacctaatgctaaatgacgagttaatgggtgcagctcaccaacatggcacatgtatacatatgtaacaaacctgcacattgtgcacatgtacccaaaaacttaaagtataataataataaaa

SEQ ID NO: 180 - DNA, 657 bp, Artificial Sequence
  Synthetic polynucleotide
atgacagagaactccgacaaagttcccattgccctggtgggacctgatgacgtggaattctgcagccccccggcgtacgctacgctgacggtgaagccctccagccccgcgcggctgctcaaggtgggagccgtggtcctcatttcgggagctgtgctgctgctctttggggccatcggggccttctacttctggaaggggagcgacagtcacatttacaatgtccattacaccatgagtatcaatgggaaattacaagatgggtcaatggaaatagacgctgggaacaacttggagacctttaaaatgggaagtggagctgaagaagcaattgcagttaatgatttccagaatggacatggatgaagctggaaaccatcattctcagcaaactatcgcaaggacaaaaaagcaaacaccgcatgttctcactcataggtgggaattgaacaatgagaacacatggatacaggaaggggaacgtcacacaccaggaactgctgtggggtggggggagggatagcatgaggagatatacctaatgctaaatgacgagttaatgggtgcagctcaccaacatggcacatgtatacatatgtaacaaacctgcacattgtgcacatgtacccaaaaacttaaagtataataataataaaa

SEQ ID NO: 181 - DNA, 657 bp, Artificial Sequence; identical to SEQ ID NO: 180
  Synthetic polynucleotide

SEQ ID NO: 182 - DNA, 1313 bp, Artificial Sequence
  Synthetic polynucleotide
atgtttccggtagcccctaaaccccaggattccagtcaaccatcagacagactcatgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 183 - DNA, 1253 bp, Artificial Sequence
  Synthetic polynucleotide
atgactgagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 184 - DNA, 1313 bp, Artificial Sequence; identical to SEQ ID NO: 182
  Synthetic polynucleotide

SEQ ID NO: 185 - DNA, 1259 bp, Artificial Sequence
  Synthetic polynucleotide
atgactgaaaaacagcaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 186 - DNA, 1313 bp, Artificial Sequence; identical to SEQ ID NO: 182
  Synthetic polynucleotide

SEQ ID NO: 187 - DNA, 1250 bp, Artificial Sequence
  Synthetic polynucleotide
atgactgaggaagaagcagaatgggaaagcataaatgtgctattgatgatgcatggcttaaaacctttgtctctagtcaaaagaacagatctcaaagatctcatcatttttgacaaacagtcatcacaaaggatgagacagaatttgaaattgttggtggaagaaacatcatgtcaacagaacatgatacaggagcttatagaaactaatcaacagcttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggacaagaacttgggactcactgaatggcgggagtgaaaggagctgtaacacgttcctggccgactcgccgggctgtgcgtggtgacaaagacaaactgcgtgagtgaagagtggtgacctttctaggggcccagacctcaggatttctgagccagaggtgctgtcacatcataggcctcccaccctccactggcacctggtggctgcgccatgcaatgggaagcagctgtggggccaggccagcccaggagccactggccagagcagggtggtgggactgaaacagctgtaacacaaatgggctgaaacatgtgccacctgaaacacatcccccgacttgctgcgctgcgggtgacaaggagagaagagttgtgactcttctgggatcccaaacctcagggctcccagagccagggctctgacacactctaacaccctctttgggcctctgtggttcctggcatctctgagctttcaggcgcccctgcattccccttgtccaggcattggtgcccacagcggaagctgcttgcagtacatctggtccagccacagtctcacatggagccagtgcctgtgctggtggctggagctgcctgcctcactgcaacagccagtgtgcctggctgtgcacatagccagaccccacatttgctaactcacacacccctcactgctctgcacctggcttgcccttagcaggcatggggtctgggctggtagcacaagctgagtgcagcctgccaggccgagtgggcagaataagcccagcaggtgtgagcaaaactcaagcagaggtaccactggccacagaggtttctggctggtgaagcgacacactgaggatc

SEQ ID NO: 188 - DNA, 1253 bp, Artificial Sequence; identical to SEQ ID NO: 183
  Synthetic polynucleotide

SEQ ID NO: 189 - DNA, 1313 bp, Artificial Sequence; identical to SEQ ID NO: 182
  Synthetic polynucleotide

SEQ ID NO: 190 - DNA, 298 bp, Artificial Sequence
  Synthetic polynucleotide
atgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 191 - DNA, 316 bp, Artificial Sequence
  Synthetic polynucleotide
atgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 192 - DNA, 298 bp, Artificial Sequence; identical to SEQ ID NO: 190
  Synthetic polynucleotide

SEQ ID NO: 193 - DNA, 211 bp, Artificial Sequence
  Synthetic polynucleotide
atgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 194 - DNA, 298 bp, Artificial Sequence; identical to SEQ ID NO: 190
  Synthetic polynucleotide

SEQ ID NO: 195 - DNA, 298 bp, Artificial Sequence; identical to SEQ ID NO: 190
  Synthetic polynucleotide

SEQ ID NO: 196 - DNA, 298 bp, Artificial Sequence; identical to SEQ ID NO: 190
  Synthetic polynucleotide

SEQ ID NO: 197 - DNA, 316 bp, Artificial Sequence; identical to SEQ ID NO: 191
  Synthetic polynucleotide

SEQ ID NO: 198 - DNA, 439 bp, Artificial Sequence
  Synthetic polynucleotide
atgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 199 - DNA, 301 bp, Artificial Sequence
  Synthetic polynucleotide
atgcctgagatcagagtcacgcccttggtaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 200 - DNA, 478 bp, Artificial Sequence
  Synthetic polynucleotide
atgcctgagatcagagtcacgcccttgggtgcctgccctgtgctgtcctggaacctggtccttccaccgggcagggggtcgagggcaccttccagcacagacaccaggacgggattccatgtcctcccccatggccccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagactttgagactgaaagttccagggagacagttttgtgtttgctcattactgactcttcggtactcgggatgaggcctggcgcacagcaggcgaatgaa

SEQ ID NO: 201 - DNA, 381 bp, Artificial Sequence
  Synthetic polynucleotide
atggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttacctttcctgcagtccaggtggctatggaaaacttctggcaggtgaaatgtgagtagagg

SEQ ID NO: 202 - DNA, 729 bp, Artificial Sequence
  Synthetic polynucleotide
atgcctgagcctcccaccccctccgttggctcctgtgctgcccgagcctcccggatgagcgccgccccctgctccagggcgcccagtcccatcgaccacccaagggctgaggagtgcgggcgcgcggcgcgggactggcaggcagctccacctgcagccccggtgagggatccactgggtgaagccagctgggctcctgagtctggtgaggacatggagaacctttatgtccagctcaagttgcagtccgtaggcacttgctttaaccgtgaagaattaccttcagtacttcagctgagcttcttccatgctccactaaaccatttcttgcatcacagtggagagtcgaagaattccatctcttggaatcactttcaagcagatgtctagcttggattcagccaatgggattcaataaagagagatttaaaagtcagaagaaaacaagaattccagtacagctgtagcaagatgcgcaggcatttggcagacatgacgttggcagcagcatccaagtgagttcctgtgaatcacccgctttgagaattcaagcaactagtgccattgcaggtggctttctcacattcttgaatttttagatctctgaggctagttaacaatctctttgacatatacaaatgcaactttacaagggagaaaaaagcatccaattctctgcattgattttttttcctactcaaaataaattcttagaatgctttaggtttt

SEQ ID NO: 203 - DNA, 729 bp, Artificial Sequence; identical to SEQ ID NO: 202
  Synthetic polynucleotide

SEQ ID NO: 204 - DNA, 500 bp, Artificial Sequence
  Synthetic polynucleotide
atggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaaatgtgagtgctttgagaggagagaggaagagctttgtcagttttgttcattgctgtattcctaggccctcaaacagagcctagcatgtagtaagtatgcaataa

SEQ ID NO: 205 - DNA, 656 bp, Artificial Sequence
  Synthetic polynucleotide
atggccttgggattaaagtgcttccgcatggtccaccctacctttcgcaattatcttgcagcctctatcagacccgtttcagaagttacactgaagacagtgcatgaaagacaacatggccataggcaatacatggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaaatgtgagtgctttgagaggagagaggaagagctttgtcagttttgttcattgctgtattcctaggccctcaaacagagcctagcatgtagtaagtatgcaataa

SEQ ID NO: 206 - DNA, 656 bp, Artificial Sequence; identical to SEQ ID NO: 205
  Synthetic polynucleotide

SEQ ID NO: 207 - DNA, 524 bp, Artificial Sequence
  Synthetic polynucleotide
atggcctattcagctgtaccagtccgccattttgctaccaagaaagccaaagccaaagggaaaggacagtcccaaaccagagtgaatattaatgctgccttggttgaggatataatcaacttggaagaggtgaatgaagaaatgaagtctgtgatagaagctctcaaggataatttcaataagactctcaatataaggacctcaccaggatcccttgacaagattgctgtggtaactgctgacgggaagcttgctttaaaccagattagccagatctccatgaagtcgccacagctgattttggtgaatatggccagcttcccagagtgtacagctgcagctatcaaggctataagagaaagtggaatgaatctgaacccagaagtggaagggacgctaattcgggtacccattccccaaatgtgagtgctttgagaggagagaggaagagctttgtcagttttgttcattgctgtattcctaggccctcaaacagagcctagcatgtagtaagtatgcaataa

SEQ ID NO: 208 - DNA, 656 bp, Artificial Sequence; identical to SEQ ID NO: 205
  Synthetic polynucleotide

SEQ ID NO: 209 - DNA, 1363 bp, Artificial Sequence
  Synthetic polynucleotide
atggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggatttttgcagatataatcaagtgaggatgaggtcatgctggattaaagtggacagttaatctaatgactagtatccttataaaaagagaagccacacagagacacacagacacacagggaagaaagccatgtgaagatggaggcagagattgcagagatgcagctacaaccaaggaacaacaaggattcccaggagctaccagaagctaggaagaggcaaagagggattcttctctagagccctcagagggagcatagccctgctgacaccttcattttggatttctagcctccaaaactgtgagataatacatttctgttgttgtaagccattcagtttgtggtaatttgct

SEQ ID NO: 210 - DNA, 2370 bp, Artificial Sequence
  Synthetic polynucleotide
atgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattgccttttgaaatgaacctcctcgatgtttcctcagatactttaccctcaacctgtgtgaaactagactcgtcatcttccctgcatattgaatttgaggtactaaggggacaccctcctgaattaagtgacctagttggtcacttacgccagaaacccagaaatgatcctcaattctttcttcactcttcctcccacatcagaatggtcactgtatatttcagtaatatctcctgtgtttaaaatttttctcttcctttccagtcttcccttcatttggctcctggactattgcattagacttcagtctggtcttctttgttcccttacaagccattcccacactgtttccacagtgtctcatctgaaatgtaaatgatgataatctgtaacttaaagtacttgaatgatttctcgttgccatatatccataagccctgaccttaacatggtttgtaagggctacataatagagttcatattttcctctctagatcatctggcatctctctctctccacgcacttc

SEQ ID NO: 211 - DNA, 2370 bp, Artificial Sequence; identical to SEQ ID NO: 210
  Synthetic polynucleotide

SEQ ID NO: 212 - DNA, 2259 bp, Artificial Sequence
  Synthetic polynucleotide
atgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattgccttttgaaatgaacctcctcgatgtttcctcagatactttaccctcaacctgtgtgaaactagactcgtcatcttccctgcatattgaatttgaggtactaaggggacaccctcctgaattaagtgacctagttggtcacttacgccagaaacccagaaatgatcctcaattctttcttcactcttcctcccacatcagaatggtcactgtatatttcagtaatatctcctgtgtttaaaatttttctcttcctttccagtcttcccttcatttggctcctggactattgcattagacttcagtctggtcttctttgttcccttacaagccattcccacactgtttccacagtgtctcatctgaaatgtaaatgatgataatctgtaacttaaagtacttgaatgatttctcgttgccatatatccataagccctgaccttaacatggtttgtaagggctacataatagagttcatattttcctctctagatcatctggcatctctctctctccacgcacttc

SEQ ID NO: 213 - DNA, 2259 bp, Artificial Sequence; identical to SEQ ID NO: 212
  Synthetic polynucleotide

SEQ ID NO: 214 - DNA, 3525 bp, Artificial Sequence
  Synthetic polynucleotide
atggacatgagggtccccgctcagctcctggggctcctgctgctctggttcccaggtgccaggtgtgacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaagactcagtggcaggtaggcccctttgcgaatgggagacggcataaacctcacctgggtgttcttttggttcccttagtcaaaatcatgaacaaagttgccaactttgaaaaaggcgttttgcaacagtagccttggaatctgttcaacaaggcctggcccagtcacttctctaagatttttacagcctgctaaccagatggaagtccaggtatccacaacctctatgcatactcagtggagcgtatagcaacagaaaactatcaatgagtgcaccagcctctcaatcttaggacacataagttgcctgaatcagccactgaatgtgtttatattgaatggcaactccttgcttgctattaggcactgatggagactgaacatgttaaggcttcagcaccatgtgtgactgtgacactggtcccttagctgtccattctcacttagatacttacaaacaccattagtaaaactgaacaatctgaacagagccatgttatcaaatggaaatggcacattcttgatcaggtttagtcaggaccccacaggatctgtggctccatgaacaaatggggagcttgctagaagggaccaaataacttgtaggtgataatttggctctttatttgcccatgtggagcccaagattcagagatttccatatggcaggagtcactgaaggctgagcaaaatgctaactgacagatccactaggtgtggccaccattcagccagtggatggccacttttttaactgaaacttaacatgggctttctacccagtgggcaaaactacattcagtggtaatggccatgcaggctgtcccaacaacgcaccatgccacatatccactaaatcctcggccattgtcaacagccttgccatctgttcaggaaaatggcaactgagagactggactattaaagaatccccagtgtgaaggaaaggactatggccacagctttccacctgcaggaaaaagaaatatgatgctgaatttgatgctgggactacctaggtaacccttgagtgcaatttatgtcatatttttggatactccatgagacttctcactcacaaaggagcatctttcactgcccaagcaacgtgacaataggcacactctcatggaacacgatgaactttccatgcaccctgcatccacaggccaatgatcctagtgaatgctagatcagtggaatcacacagcaatatgcagaaaggacatctacaaagtctgttaatggggtggtatcccatctgactagagaaatatgtacattaaagatcctgggccacaaaaagggaaatagtgcatgttgagaaacacagagctgggtggaagtaaaggtaggccaggcagacacttatattagtctggacctgtgaaagctatttcagtgttcctaaccattccttttctttttttcctttagaatacatgctctggggtggtttgcaatctaggccattacaatgccccagacaggccccctaactctaataggaggattatgtttcctctgggtgcttcctttctacaagatcccacagtgatggataacaagactaagaaatatcacggagctaggggccctcttctggtgccagggacatcttatcctccctttagtgttggtgatattatgaaatatgtccagtttttacagggcagaatctcccttcctggagtggacaatcaggactgaaatatctggatcaagtgacaaaggcaatggattgttcacagagcaaggacagccagaccgcattcctacaccaacacggcccaacccttgtagatgggtaggggacacctgagaccctgggatgggtgagagacgatgcattaacctgtgaggctgcattttgacaagaatgaggcagcaaaggcctagaagcacaatgtctttgttagcttcttttaggtcaccagggtgatctttcaaaatagtgaatctcccattcttgacctcattctgtcattaactagaggttccctttcattctaccaagggtaaattacaccaacattcctaatactaaggtgtacatcaaaaggacccaagcactggcccacaaagtgagaatctgacacctgccacatgggaggaaactggaggacccctgtttaacttaattgcctctggcgaatgtcatgaccacaattaaaaaaaacattggtggactaatattttgatgcaccatacttttttgattgcatagatgagaaacatcccaatggcaatgataaaaacaaggactggactaatgctagccctctgtctacagacaatattgtatgagcaaaactttgctcatgcaactctactatcagtgagacttggctaatgaacgcaccaataccagcataaccatgacagagtgattgaagaaaaatgggaaaaggggggctgtatgcacccaagggctacatctttctctgtaagcggtttgggagtgaccaaaatgcaggatatgtgatgccatctctggatatctgtggaatagtgagatcctgcatgttgggcatgctggggttgtctctggatattgctccttggaattaggtaaatcatagagcctgaagcccaaagctgtacctcagacttactagggacctaccagaaggtacaacagatgataggtttatgtcttttatgatatttttggtactatgtataggagtcagtgctcatgaaaaaaagtgaaatgataaggaacttgtccctgaccatggcagatattgctcctcctccatagccactgccttggtaacccagcagacatcccttaactccatcgggatggatgtttaagataacagtgttgctctagacctttaaaaaatcccaactgggaggaatgtatacaatttccaataccccctgctatacctggataaacacctcaggtatcctagaaattcaagtagaggagatctggaaacaagctcataattgcagaaaatggattctgcagattcagaaaatcccacctgaaggattcttctttcacccctttagcaacttcttctgtggatcatgggatcctgggctacataactgcttcaggtgggcctgatcattctgcctctggtagtagttttcattggcccagtgaaatcttttctggctctgtctcaatgatgttgctttgagattgtgtcagtcaaggtgcttcatccgtctgacaagacacacctgtgcctccagttcacggtggttggtaggcgtataaaatggaatagctttctacggaggatgtctgtgttggggg

SEQ ID NO: 215 - DNA, 775 bp, Artificial Sequence
  Synthetic polynucleotide
atgagggaacctatatacatgcactcgacaatggtctttttaccctgggagctccacacaaagaagggccctagtcctccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagatttggctaccatgttctttttgtgcctattttaacagagtctcagtcatagcctgccttcatctctgaagggaccaggcgacccatggagtgcctcggcagcctcgtcattgcatgcaatcttcacagacaagatctcactgcaaccacgtttctacaggagcacaggtgtgacattatactgatgacatcattctcagagaaaattcattttacatactaaggacacacagatacaa

SEQ ID NO: 216 - DNA, 775 bp, Artificial Sequence; identical to SEQ ID NO: 215
  Synthetic polynucleotide

SEQ ID NO: 217 - DNA, 2153 bp, Artificial Sequence
  Synthetic polynucleotide
atgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaa

SEQ ID NO: 218 - DNA, 2153 bp, Artificial Sequence; identical to SEQ ID NO: 217
  Synthetic polynucleotide

SEQ ID NO: 219 - DNA, 2153 bp, Artificial Sequence; identical to SEQ ID NO: 217
  Synthetic polynucleotide

SEQ ID NO: 220 - DNA, 2153 bp, Artificial Sequence; identical to SEQ ID NO: 217
  Synthetic polynucleotide

SEQ ID NO: 221 - DNA, 1766 bp, Artificial Sequence
  Synthetic polynucleotide
atggcaattactgtctcattagtgaacaataaaagaaaaattgttgtattagcacaacctactactgtgaagaggaaaagaattaccccatacaagtctataatgacggatctatactacctcagtcagacagatggagcaggtgattggcgggaaaaagaggccaaagatctgacagaactggttcagcggagaataacatatcttcagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaa

SEQ ID NO: 222 - DNA, 1664 bp, Artificial Sequence
  Synthetic polynucleotide
atgacggatctatactacctcagtcagacagatggagcaggtgattggcgggaaaaagaggccaaagatctgacagaactggttcagcggagaataacatatcttcagggtctccctctccctctctttccacggtctccctctgatgctgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcctgaggtgcctggattgcagacggagtctcgttcactcagtgctcagtggtgcccaggctggagtgcagtggcgtgatctcggctcgctacaacctccacctcccagccgcctgccttggcctcccaaagtgccgagattgcagcctctgcctggccgccaccccgtctgggatgtgaggagcccctctgcctggctgcccagtctggaaagtgaggagcgtctctgcccagccgccatcccatctaggaagtgaggagcgcctcttcccggccaccatcccatctaggaagtgaggagcgtctctgcccggccgcccatcgtctgagatgtggggagcgcctctgccccgccgccccgtctgggatgtgaggagcgcctctgcccggccacgaccccgtctgggaggtgaggagcgtctctgcccggctgccccatctgagaagtgaggagaccctctgccaggcagccgccccgtctgagaagtgaggagcccctccgcccggcagccaccccgtctgagaagtgaggagcgtctccgcccggcagccaccctgtccgggagggaggtggggggtcagcccccactcggccagctgccctgtccaggagggaggtgggggtcagcccccgcccggccagctgccccgtccgggagggaggtggggggtcagcccctgcccggctagccgccccatccgggaggtgaggggcgcctctgcccggccaccgctactgggaagtgaggagcccctctgcccggccaccacccggtctgggaggtgtacccaacagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagcgttaaatggattaagggcggtgcaagatgtgctttgttaaacagatgcttgaaggcaacatgctcgttaagagtcatcaccactccctaatctcaagtatccagggacacaaacactgcggaaggctgcagggtcctctgcctaggaaaaccagagacctttgttcacttgtttatctgtggaccttccctccactattgtcctatgaccctgccaaatccccctctgcgagaaacacccaagaatgatcaattaaaaaaaaaaaaaaaaaaa

SEQ ID NO: 223 - DNA, 91 bp, Artificial Sequence
  Synthetic polynucleotide
atgaaggctccgaccgtgtggccccaggcaggtggcatccactctgcagtgtcagtaccttgctatccctgtaaaacggaggtaacgctac

SEQ ID NO: 224 - DNA, 1049 bp, Artificial Sequence
  Synthetic polynucleotide
atggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgcaacaaaatcctaggactcaacctaacaaaaggcacgtaaaaccttcatagaaaaaaatagaatttttaaaagacatttttaaaggacctaagtagaaggagaaataatctacgttaatgaataggaagactcgatttcataaagatcatttctgccaagtcaaactacaaattcagagaattttcataagaattccagcagatactttgtggaatttaacaagctttgccctaaaattcatatggaagataaaggagccaggaatatctaaggcaatttgaagaaaaacaagaaagaaggacttgttcttccaaatatcaagatgttatcttacagctataataatgaaggcag

SEQ ID NO: 225 - DNA, 499 bp, Artificial Sequence
  Synthetic polynucleotide
atggtgtcttgtgaaaggagggcaagcaaaagtgtaggacaaattttgctttgggattttggttacacctgcagactatcccacagaaggaggaacagcactgaaatcctttctcgcaatcttcctgcattgtacacagaaaattgaaactgggcctcttccttatgccttatacaaaaattaactcaagatggattaaaggcttaactgtaaaactccagactataaaaactctagaagaaaatctgggcaataccattcaggacataggcattggcaaagatttcatgacaaaatcaccaaaagcaattgcaacaaaagcaaaaattgacaaatggcatctaattaaactaaagagcttctgtacagcaaaatagactatcatcagagtgaacagacaacctacaaaatgggagaaaatgtttgcaatctatccacctgacaaacgtctagtatccagagtctacaaggaacttaaatttataagaaaaaacaaaca

SEQ ID NO: 226 - DNA, 1416 bp, Artificial Sequence
  Synthetic polynucleotide
atggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatatggcactttatgagaagatggacacagtgatcagcaatgggcaagacagctattggagaagtggcaagacagcgatcagtgagagaggatgagacggtgatcagcgctacagcgatcaaagctacagtgtctgtgtgtctgtgtgactttatgctgagttgttaacattgcagagctattaacactagccaaaggctgttttaagaaccatcatctttcctgacaggtgttggagctctggggatgggcaagaggccacagagccactgcttcatgcaggccagccgctccgtgctccagttcccccataggagcccaacccatccgagctgggaagcctggagagatcttcatgcaggccccatgtcagacactgcttggccccattttggctcctgcacacctgtaagtgtcccatctatccacctgcctatatagatgatccaggaaataaggcctttggctagatagtccatttgaattcccccatagcacacctgactacatcctcattgttctttctcttagtcatttctcctctaatgccattttatttatccatcagccattttattttattttctgccccgatatatgtgtttgctttgcagttttttctttgggtccctgctaattatgtttgtgcaattgtttaaggcaggacacttggatgtaagaattctcctgttctgttgactctaagaagccagagtcacattgttttatggccccaaccaggcctttggggctcattgttggccaccccactgaggctccaggattttctgcactggtcagcccctggatactccagggtttcctggcatttggtgtggggacactcataggctgttacttgggtattctgggttttcagcatttggtattttgggccactatctggatgctccagagttttcacccttgacattcctccttggattgtgcattggaggcttgccctacaggaatcttggtttgccttttcttgttttctgccctaaagttatcgttttccattacggcattttgttttcttattgtcaccttacttacactttttcttctacactttacttaataaaaatattgcttaaatccca

SEQ ID NO: 227 - DNA, 1027 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 228 - DNA, 1114 bp, Artificial Sequence
  Synthetic polynucleotide
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 229 - DNA, 553 bp, Artificial Sequence
  Synthetic polynucleotide
atggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 230 - DNA, 1114 bp, Artificial Sequence; identical to SEQ ID NO: 228
  Synthetic polynucleotide

SEQ ID NO: 231 - DNA, 1156 bp, Artificial Sequence
  Synthetic polynucleotide
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 232 - DNA, 985 bp, Artificial Sequence
  Synthetic polynucleotide
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 233 - DNA, 1069 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 234 - DNA, 1072 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 235 - DNA, 1072 bp, Artificial Sequence; identical to SEQ ID NO: 234
  Synthetic polynucleotide

SEQ ID NO: 236 - DNA, 943 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccagggttgattcaactgatctggctggccaggcaggtgtccccttcatccctctccactccatgtgcatccctcccaaagctgcatgctcagttgacgagcatgaccgtccccgatacaggaggaccagtcttcagtcaagggtatatgagtagcacccctgctggaacctccaaacaagatc

SEQ ID NO: 237 - DNA, 459 bp, Artificial Sequence
  Synthetic polynucleotide
atggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcatgcgcagtggctcacacctgtaatcccagcactttgggaggctgaggcaggcggatcatgaggtcaggagatcgagaccatcctggctaacatggtaaaaccccgtctctactaaaaatacaaaaaattagctgggcatggtggcacacgcctgtagtcccagctacttgggaggctgaggcaggaaaatcacttgaacccaggagacagaggctgtggtgagctgagatcacaccactgcactccagcctgggcgacagagcaagactcagtctaaaaaaaaaaaaaa

SEQ ID NO: 238 - DNA, 459 bp, Artificial Sequence; identical to SEQ ID NO: 237
  Synthetic polynucleotide

SEQ ID NO: 239 - DNA, 459 bp, Artificial Sequence; identical to SEQ ID NO: 237
  Synthetic polynucleotide

SEQ ID NO: 240 - DNA, 459 bp, Artificial Sequence; identical to SEQ ID NO: 237
  Synthetic polynucleotide

SEQ ID NO: 241 - DNA, 459 bp, Artificial Sequence; identical to SEQ ID NO: 237
  Synthetic polynucleotide

SEQ ID NO: 242 - DNA, 3321 bp, Artificial Sequence
  Synthetic polynucleotide
atgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatgagacaggagacagccaagagtccctggcgaaaccccacctccaagcctaaaacagcctgaaggctgaaaaactggactgctggtccccagtgaaggccctgccctttcccagctgattctccctaagtaatgtccacctgcgcactggggaaagaggatggagccacaggaagttcgtgtcatttgcagtggggaggagcctggcctcttcagtttctgtgtggtaacctgggattcaatctgtgaggcaggaggttgttggcaagaccccctctctatttgctgagagtttttgtttcctttttgaccaataaattccatttttctcacccctctatgtttccgtgagcctaatctttcctggtagtgtgacaagagcctggttttagctgaactaaggagaaagttctgcaaca

SEQ ID NO: 243 - DNA, 3429 bp, Artificial Sequence
  Synthetic polynucleotide
atgactagactgggctggccgagcccatgttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatgagacaggagacagccaagagtccctggcgaaaccccacctccaagcctaaaacagcctgaaggctgaaaaactggactgctggtccccagtgaaggccctgccctttcccagctgattctccctaagtaatgtccacctgcgcactggggaaagaggatggagccacaggaagttcgtgtcatttgcagtggggaggagcctggcctcttcagtttctgtgtggtaacctgggattcaatctgtgaggcaggaggttgttggcaagaccccctctctatttgctgagagtttttgtttcctttttgaccaataaattccatttttctcacccctctatgtttccgtgagcctaatctttcctggtagtgtgacaagagcctggttttagctgaactaaggagaaagttctgcaaca

SEQ ID NO: 244 - DNA, 3456 bp, Artificial Sequence
  Synthetic polynucleotide
atggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgacctttctaggcaaagattggggcctagaggagatgtctgagtactcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatgagacaggagacagccaagagtccctggcgaaaccccacctccaagcctaaaacagcctgaaggctgaaaaactggactgctggtccccagtgaaggccctgccctttcccagctgattctccctaagtaatgtccacctgcgcactggggaaagaggatggagccacaggaagttcgtgtcatttgcagtggggaggagcctggcctcttcagtttctgtgtggtaacctgggattcaatctgtgaggcaggaggttgttggcaagaccccctctctatttgctgagagtttttgtttcctttttgaccaataaattccatttttctcacccctctatgtttccgtgagcctaatctttcctggtagtgtgacaagagcctggttttagctgaactaaggagaaagttctgcaaca

SEQ ID NO: 245 - DNA, 3456 bp, Artificial Sequence; identical to SEQ ID NO: 244
  Synthetic polynucleotide

SEQ ID NO: 246 - DNA, 327 bp, Artificial Sequence
  Synthetic polynucleotide
cagcggccagatcggcttcatgctgtgcagcaagaacccggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaa

SEQ ID NO: 247 - DNA, 1052 bp, Artificial Sequence
  Synthetic polynucleotide
atggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccggccaggtgcggtgtctcatgcctgtaattccagcattttgggagaccaaggtgggcggatcacttgaggtcaggagtacaagaccagcctgaccaacatggagaaaccccatcactactcaaaatacaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaa

SEQ ID NO: 248 - DNA, 3220 bp, Artificial Sequence
  Synthetic polynucleotide
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaga

SEQ ID NO: 249 - DNA, 609 bp, Artificial Sequence
  Synthetic polynucleotide
ctggcgaggcagaggcaagcgaccagcagcagaagatcatacccaggccacgtgcagccggccacagcaagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 250 - DNA, 738 bp, Artificial Sequence
  Synthetic polynucleotide
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 251 - DNA, 537 bp, Artificial Sequence
  Synthetic polynucleotide
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 252 - DNA, 537 bp, Artificial Sequence; identical to SEQ ID NO: 251
  Synthetic polynucleotide

SEQ ID NO: 253 - DNA, 684 bp, Artificial Sequence
  Synthetic polynucleotide
ggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacggggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 254 - DNA, 552 bp, Artificial Sequence
  Synthetic polynucleotide
atgtctgttttcagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 255 - DNA, 285 bp, Artificial Sequence
  Synthetic polynucleotide
atgaactacatcactgcaataattgaggagcagcccaaaaactatcaagtttgaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaa

SEQ ID NO: 256 - DNA, 285 bp, Artificial Sequence; identical to SEQ ID NO: 255
  Synthetic polynucleotide

SEQ ID NO: 257 - DNA, 82 bp, Artificial Sequence
  Synthetic polynucleotide
atggagggttgaaccatatgaaattgccagtattcaactgcttggacttagcaaaatgtcagtttcatatggttaaccctaa

SEQ ID NO: 258 - DNA, 102 bp, Artificial Sequence
  Synthetic polynucleotide
atgggtggattattttctcgatggagggttgaaccatatgaaattgccagtattcaactgcttggacttagcaaaatgtcagtttcatatggttaaccctaa

SEQ ID NO: 259 - DNA, 102 bp, Artificial Sequence; identical to SEQ ID NO: 258
  Synthetic polynucleotide

SEQ ID NO: 260 - DNA, 102 bp, Artificial Sequence; identical to SEQ ID NO: 258
  Synthetic polynucleotide

SEQ ID NO: 261 - DNA, 763 bp, Artificial Sequence
  Synthetic polynucleotide
atgccttttgctcccgttgcccaggctagagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgggctatgctggaaaccttgactaacaccatgaaacccacataaagtgccactagtgatgctggaagtgctcccaatgagcagagaaaaatcatgacattacaagaaaaagatgaattacttgatatgtactgtagattaaggtctgcagctgtagttcctcaccatttctgacagttcatcttgtaaacagatgacaagcttatggtattaatactttacaatactgtaaatattttatcttccttatgattttcttaataacttttttctctagctttattgtaagaatacacaatataatacatataacacacgaaatatgtattaattgactttgtggcatctggtcaacagtaggctattggtagttaagtttttggggagtcaagagttatacttggatttttgactacatgggggatttggcactcctaaccctcgagttcctcaagggtcagttg

SEQ ID NO: 262 - DNA, 646 bp, Artificial Sequence
  Synthetic polynucleotide
atgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgggctatgctggaaaccttgactaacaccatgaaacccacataaagtgccactagtgatgctggaagtgctcccaatgagcagagaaaaatcatgacattacaagaaaaagatgaattacttgatatgtactgtagattaaggtctgcagctgtagttcctcaccatttctgacagttcatcttgtaaacagatgacaagcttatggtattaatactttacaatactgtaaatattttatcttccttatgattttcttaataacttttttctctagctttattgtaagaatacacaatataatacatataacacacgaaatatgtattaattgactttgtggcatctggtcaacagtaggctattggtagttaagtttttggggagtcaagagttatacttggatttttgactacatgggggatttggcactcctaaccctcgagttcctcaagggtcagttg

SEQ ID NO: 263 - DNA, 646 bp, Artificial Sequence; identical to SEQ ID NO: 262
  Synthetic polynucleotide

SEQ ID NO: 264 - DNA, 646 bp, Artificial Sequence; identical to SEQ ID NO: 262
  Synthetic polynucleotide

SEQ ID NO: 265 - DNA, 258 bp, Artificial Sequence
  Synthetic polynucleotide
atggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagaggtttgctgtgac

SEQ ID NO: 266 - DNA, 258 bp, Artificial Sequence; identical to SEQ ID NO: 265
  Synthetic polynucleotide

SEQ ID NO: 267 - DNA, 243 bp, Artificial Sequence
  Synthetic polynucleotide
atgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagaggtttgctgtgac

SEQ ID NO: 268 - DNA, 324 bp, Artificial Sequence
  Synthetic polynucleotide
gacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccatgtagggcctctcccaagatcctgcttctctcctcaggatgaccaactcttggatgatggcaagacactgggcgagtgtggcttcaccagtcaaacagcacggccacaggccccagccacagtggggctggccttccgggcagaggtttgctgtgac

SEQ ID NO: 269 - DNA, 728 bp, Artificial Sequence
  Synthetic polynucleotide
atgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctataaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 270 - DNA, 728 bp, Artificial Sequence; identical to SEQ ID NO: 269
  Synthetic polynucleotide

SEQ ID NO: 271 - DNA, 663 bp, Artificial Sequence
  Synthetic polynucleotide
aaacatccagaatacatttccaacaagagcactggccaagtcaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagacccttctttaacagttagagctgacatagctggaagatactctaacagattgtacacatatgagcctcgggatttacccctataaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 272 - DNA, 1682 bp, Artificial Sequence
  Synthetic polynucleotide
atggccgagagcatcataattcgtgtccagtccccggatggagtgaagcggatcacagcaacaaagagagaaacagcagcaacatttttgaaaaaggttgcaaaggagtttggcttccaaaataatggcttctcggtttacatcaatagaaacaagaccggagagataacagcctcctccaacaaatccctcaacttgctaaaaatcaagcatggcgatttgttgttcctgtttccctcgagccttgctgggccctcatctgaaatggagacgtcagttccaccgggcttcaaagtctttggcgctcccaacgtggtggaggatgagattgatcagtacctcagcaaacaggacgggaagatttacagaagccgagacccacagctatgccgccacggccctttggggaaatgcgtgcactgcgtccctctagagccattcgatgaggactatctaaaccatctcgagcctcccgtgaagcacatgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 273 - DNA, 1199 bp, Artificial Sequence
  Synthetic polynucleotide
atgtccttccacgcctacatccggaagctgactggaggggctgacaaggggaagtttgttgccctggagaacatcagctgcaagattaagtcagggtgcgaggggcacctcccgtggccgaatggcatctgtactaagtgccagccgagcgccatcacgctgaacagacagaagtacaggcatgtggacaatatcatgtttgagaatcacaccgtcgctgaccgctttcttgacttctggagaaagacagggaaccagcattttgggtacttatacggacggtacacggagcacaaagacattccccttggcatcagggctgaagtggctgcgatttatgagccacctcagattggtacacagaacagcttggagcttcttgaggatccaaaagctgaagtggtcgatgaaattgctgccaaacttggcctgcggaaggttggctggatatttacagacctcgtctcagaagatacccgaaagggtaccgtccgctacagtcgaaataaggacacctatttcctaagttcagaagagtgcatcactgcaggagacttccagaacaagcatcccaacatgtgccggctctctccagacggacattttggatccaagtttgttactgcagtggctacaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 274 - DNA, 76 bp, Artificial Sequence
  Synthetic polynucleotide
atgaggagctcgcccagacatggaagaggtctgagcagtgggccaccatcgagcagctgtgcaatctcggcttact

SEQ ID NO: 275 - DNA, 76 bp, Artificial Sequence; identical to SEQ ID NO: 274
  Synthetic polynucleotide

SEQ ID NO: 276 - DNA, 1682 bp, Artificial Sequence; identical to SEQ ID NO: 272
  Synthetic polynucleotide

SEQ ID NO: 277 - DNA, 282 bp, Artificial Sequence
  Synthetic polynucleotide
gcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 278 - DNA, 386 bp, Artificial Sequence
  Synthetic polynucleotide
ggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 279 - DNA, 423 bp, Artificial Sequence
  Synthetic polynucleotide
tttacactttttctatttcgcaaaatccatttcctattgaaaaccgggatgtattgggtgagacacagacagagtctcactctatcacccaggctggagtgcagtggtgcgatcttggctcactacaacctccacctcctgggttcaagcgattcttctgcttcagcctcctgagtagctgggattataggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 280 - DNA, 320 bp, Artificial Sequence
  Synthetic polynucleotide
actttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcaatctcggcttact

SEQ ID NO: 281 - DNA, 1209 bp, Artificial Sequence
  Synthetic polynucleotide
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctcaggtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcag

SEQ ID NO: 282 - DNA, 1206 bp, Artificial Sequence
  Synthetic polynucleotide
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcag

SEQ ID NO: 283 - DNA, 1206 bp, Artificial Sequence; identical to SEQ ID NO: 282
  Synthetic polynucleotide

SEQ ID NO: 284 - DNA, 1206 bp, Artificial Sequence; identical to SEQ ID NO: 282
  Synthetic polynucleotide

SEQ ID NO: 285 - DNA, 1206 bp, Artificial Sequence; identical to SEQ ID NO: 282
  Synthetic polynucleotide

SEQ ID NO: 286 - DNA, 1203 bp, Artificial Sequence
  Synthetic polynucleotide
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggaggatcccaggccctcacccacaaggtccgtctcaacagctggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcag

SEQ ID NO: 287 - DNA, 529 bp, Artificial Sequence
  Synthetic polynucleotide
gacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagatgcggatctccccttggtcattcaaggcactgctcaggcatcttatgcaagaaggcgtcccaggttgcgaaggtgactcagacgcctcctttgggactccaacacccttccccggcagagcccctgcctgtctgcctccgtggtgtcaggttttgtgccctctactcactagattgtggacacagaaagcgctgg

SEQ ID NO: 288 - DNA, 2161 bp, Artificial Sequence
  Synthetic polynucleotide
atgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagatgcggatctccccttggtcattcaaggcactgctcaggcatcttatgcaagaaggcgtcccaggttgcgaaggtgactcagacgcctcctttgggactccaacacccttccccggcagagcccctgcctgtctgcctccgtggtgtcaggttttgtgccctctactcactagattgtggacacagaaagcgctgg

SEQ ID NO: 289 - DNA, 2140 bp, Artificial Sequence
  Synthetic polynucleotide
atgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagatgcggatctccccttggtcattcaaggcactgctcaggcatcttatgcaagaaggcgtcccaggttgcgaaggtgactcagacgcctcctttgggactccaacacccttccccggcagagcccctgcctgtctgcctccgtggtgtcaggttttgtgccctctactcactagattgtggacacagaaagcgctgg

SEQ ID NO: 290 - DNA, 2161 bp, Artificial Sequence; identical to SEQ ID NO: 288
  Synthetic polynucleotide

SEQ ID NO: 291 - DNA, 55 bp, Artificial Sequence
  Synthetic polynucleotide
atggcgtgcttgttggagaccccaatccgcatgagcgtcctttcgtttttttaaa

SEQ ID NO: 292 - DNA, 55 bp, Artificial Sequence; identical to SEQ ID NO: 291
  Synthetic polynucleotide

SEQ ID NO: 293 - DNA, 55 bp, Artificial Sequence; identical to SEQ ID NO: 291
  Synthetic polynucleotide

SEQ ID NO: 294 - DNA, 55 bp, Artificial Sequence; identical to SEQ ID NO: 291
  Synthetic polynucleotide

SEQ ID NO: 295 - DNA, 55 bp, Artificial Sequence; identical to SEQ ID NO: 291
  Synthetic polynucleotide

SEQ ID NO: 296 - DNA, 55 bp, Artificial Sequence; identical to SEQ ID NO: 291
  Synthetic polynucleotide

SEQ ID NO: 297 - DNA, 55 bp, Artificial Sequence; identical to SEQ ID NO: 291
  Synthetic polynucleotide

SEQ ID NO: 298 - DNA, 25 bp, Artificial Sequence
  Synthetic polynucleotide
atgagcgtcctttcgtttttttaaa

SEQ ID NO: 299 - DNA, 377 bp, Artificial Sequence
  Synthetic polynucleotide
atggctgtagctgcagtaaaatgggtgatgtcaaagagaactatcttgaaacatttatttccagtccaaaatggagctttatattgtgtttgtcataaatctacgtattctcctctaccagatgactataattgcaacgtagagcttgctctgacttctgatggcaggacaatagtatgctaccacccttctgtggacattccatatgaacacacaaaacatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaa

SEQ ID NO: 300 - DNA, 377 bp, Artificial Sequence
  Synthetic polynucleotide
atgggtgatgtcaaagagaactatcttgaaacatttatttccagtccaaaattcgggcgtacatgtgcagatggagctttatattgtgtttgtcataaatctacgtattctcctctaccagatgactataattgcaacgtagagcttgctctgacttctgatggcaggacaatagtatgctaccacccttctgtggacattccatatgaacacacaaaacatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaa

SEQ ID NO: 301 - DNA, 377 bp, Artificial Sequence; identical to SEQ ID NO: 299
  Synthetic polynucleotide

SEQ ID NO: 302 - DNA, 377 bp, Artificial Sequence; identical to SEQ ID NO: 299
  Synthetic polynucleotide

SEQ ID NO: 303 - DNA, 377 bp, Artificial Sequence; identical to SEQ ID NO: 299
  Synthetic polynucleotide

SEQ ID NO: 304 - DNA, 377 bp, Artificial Sequence; identical to SEQ ID NO: 299
  Synthetic polynucleotide

SEQ ID NO: 305 - DNA, 377 bp, Artificial Sequence; identical to SEQ ID NO: 299
  Synthetic polynucleotide

SEQ ID NO: 306 - DNA, 1055 bp, Artificial Sequence
  Synthetic polynucleotide
atggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccaggaagaaccaagtgagagcactgca

SEQ ID NO: 307 - DNA, 1072 bp, Artificial Sequence
  Synthetic polynucleotide
atggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaataca

SEQ ID NO: 308 - DNA, 1072 bp, Artificial Sequence; identical to SEQ ID NO: 307
  Synthetic polynucleotide

SEQ ID NO: 309 - DNA, 1072 bp, Artificial Sequence; identical to SEQ ID NO: 307
  Synthetic polynucleotide

SEQ ID NO: 310 - DNA, 196 bp, Artificial Sequence
  Synthetic polynucleotide
atgggcgctgcccactccgcgtctgaggaggtgcgggagctcgagggcaagaccggctttgcagctacccaggaggccaaggtgggaggatctctggagcccaggaggtggaggctgcagtgagctgagatgccgaggtcgtgccagtgtactccagcctgagtgatggaagtgaaaccctgccacagaaaacaaa

SEQ ID NO: 311 - DNA, 196 bp, Artificial Sequence; identical to SEQ ID NO: 310
  Synthetic polynucleotide

SEQ ID NO: 312 - DNA, 196 bp, Artificial Sequence; identical to SEQ ID NO: 310
  Synthetic polynucleotide

SEQ ID NO: 313 - DNA, 196 bp, Artificial Sequence; identical to SEQ ID NO: 310
  Synthetic polynucleotide

SEQ ID NO: 314 - DNA, 355 bp, Artificial Sequence
  Synthetic polynucleotide
atgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggctttgcagctacccaggaggccaaggtgggaggatctctggagcccaggaggtggaggctgcagtgagctgagatgccgaggtcgtgccagtgtactccagcctgagtgatggaagtgaaaccctgccacagaaaacaaa

SEQ ID NO: 315 - DNA, 225 bp, Artificial Sequence
  Synthetic polynucleotide
atgcgtgcgcccattccagagcctaagcctggagacctgattgagatttttcgccctttctacagacactgggccatctatgttggcgatggatatgtggttcatctggcccctccaacgtcttctcagtagcatgggaattgcttgagggcaggcctgctgtccagatcacgtcactgacttcagcaccttggacaaggcccggcacccagtagggcctcagta

SEQ ID NO: 316 - DNA, 225 bp, Artificial Sequence; identical to SEQ ID NO: 315
  Synthetic polynucleotide

SEQ ID NO: 317 - DNA, 516 bp, Artificial Sequence
  Synthetic polynucleotide
atggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggtgggtgcttttaattccagctactaagaaggctgaggcaggagaattgcttgaatccaggaggtggaggttgcagtgagccgagactgcaccattgcactccagcctgggcgacagcgtgggactctgtctcaaaaacaacaacaacaacaaaaagaaaa

SEQ ID NO: 318 - DNA, 516 bp, Artificial Sequence; identical to SEQ ID NO: 317
  Synthetic polynucleotide

SEQ ID NO: 319 - DNA, 890 bp, Artificial Sequence
  Synthetic polynucleotide
atggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagggctggtgtgagttgcagtttcttctccttgcaaaacatctgaagaaaatctcagtgttcctggtaagcatgcctgcttaatgacttgcggtgtcctggtcagtgcggtaatgcatcacgttatatttttcatctttctttcctcaattccacctttgctttcactctcactgccctgggcttgc

SEQ ID NO: 320 - DNA, 947 bp, Artificial Sequence
  Synthetic polynucleotide
atggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagggctggtgtgagttgcagtttcttctccttgcaaaacatctgaagaaaatctcagtgttcctggtaagcatgcctgcttaatgacttgcggtgtcctggtcagtgcggtaatgcatcacgttatatttttcatctttctttcctcaattccacctttgctttcactctcactgccctgggcttgc

SEQ ID NO: 321 - DNA, 947 bp, Artificial Sequence; identical to SEQ ID NO: 320
  Synthetic polynucleotide

SEQ ID NO: 322 - DNA, 503 bp, Artificial Sequence
  Synthetic polynucleotide
atggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactg

SEQ ID NO: 323 - DNA, 503 bp, Artificial Sequence; identical to SEQ ID NO: 322
  Synthetic polynucleotide

SEQ ID NO: 324 - DNA, 637 bp, Artificial Sequence
  Synthetic polynucleotide
gaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagggttgaggccaattgtggcatcttgaagacactcaggcagcctatggagaaacgcctttgataaggaatagaagcttgccagcagccactcgagtgagcttaggagtgggttcaccagcaccagtgaagctttgagataactgatgccctggctgacccgttgactgtaatctgatgagagatgctgaaccaaaaccatccaggtgagccactcctagattcctgacactcaaaaactgtgtgagatgagaaatgattgttattttaagatgctaaattctgagataatttgttatgggggcaaaatgtaactcatata

SEQ ID NO: 325 - DNA, 950 bp, Artificial Sequence
  Synthetic polynucleotide
atggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagggttgaggccaattgtggcatcttgaagacactcaggcagcctatggagaaacgcctttgataaggaatagaagcttgccagcagccactcgagtgagcttaggagtgggttcaccagcaccagtgaagctttgagataactgatgccctggctgacccgttgactgtaatctgatgagagatgctgaaccaaaaccatccaggtgagccactcctagattcctgacactcaaaaactgtgtgagatgagaaatgattgttattttaagatgctaaattctgagataatttgttatgggggcaaaatgtaactcatata

SEQ ID NO: 326 - DNA, 1324 bp, Artificial Sequence
  Synthetic polynucleotide
cttccaccaagggcccatcggtcttccccctggcgccctgctccaggagcacctctgggggcacagcggccctgggctgcctggtcaaggactacttcccagaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatgacagagacggccggcaaagcccagcagcagggagagagcctgggacagagtctcccatgacacagaggtgccagccccaccgaggcctccatcccagatgcccggcctccagaaccaggacggaataaacgtctgttgtttaagccacgcagtctggggtgctgtgttgccagggccacagttaacggatac

SEQ ID NO: 327 - DNA, 1606 bp, Artificial Sequence
  Synthetic polynucleotide
atgctaaggaggttggacaaaatcaggttcagaggtcacaagagagatgacttcctcgatctagcggagtctccaaatgcctcggacaccgaatgcagcgacgaaatccccctgaaggtaccgcggacctcgccccgggacagcgaggagctgagggaccctgctggtccagggaccctcatcatggccacaggagtccaggactttaaccggacagagtttgatcgactgaatgagatcaaaggtcacctggaaattgccttattggaaaaacatttcttacaggaggagctccggaagctgcgagaagaaaccaacgcggagatgctgcggcaggagctggaccgcgagcggcagcggcggatggagctggagcagaaggtgcaggaggtgctgaaggccagaaccgaggagcagatggctcagcagcccccaaaagggcaggcccaggccagcaatggagcagagcgccggagccaggggctgtcctcgcgcctgcagaagtggttctacgagcggtttggggagtacgtggaggacttccggttccagcccgaggagaacactgtggagacagaggaacccctgagcgcccgcaggttaactgaaaatatgagacggctcaagcgcggtgccaagccggtcactaactttgtgaagaacctctctgccttatccgactggtactccgtctacacgtctgccattgccttcaccgtgtacatgaatgccgtgtggcatggctgggccatcccattgttcttatttctagcaattctgaggttatccctcaattacctcatcgccagggggtggcggatacagtggagcatcgtgcccgaagtgtctgagcccgtggaacctccaaaggaagacctgactgtgtctgagaagttccagctggtgctggacgtcgcccagaaagcccagaaccttttcgggaagatggctgacatcctggagaagatcaagaacttgttcatgtgggtccagccggagatcacacagaagctgtatgtggcgctctgggctgccttcctggcctcctgcttcttcccctaccgcctggtggggcttgccgtgggactctatgctggtatcaagttcttcctcattgatttcatctttaaacgctgcccgaggctgcgcgccaagtacgacacgccctatatcatctggaggagtctccccaccgacccgcagctcaaggagcgctccagcgccgcagtctcacgcaggctgcagacgacctcgtcacggagctacgtacccagcgcaccggccggcctgggtaaagaggaggacgccggtcgcttccacagcaccaagaagggcaatttccacgagatcttcaatctgacagaaaacgagcgtccgctggcggtgtgcgagaatggctggcgctgctgcctcatcaacagggaccggaagatgcccacggactacatcaggaacggggtgctctacgtcacggagaattacttgtgcttcgaaagctccaaatctgggtcctcaaagaggaacaaagtcatcaagctagtggacatcacggacatccagaaggtaaatcatcatcataggagtgtggaagctgctggtacaaaat

SEQ ID NO: 328 - DNA, 1606 bp, Artificial Sequence; identical to SEQ ID NO: 327
  Synthetic polynucleotide

SEQ ID NO: 329 - DNA, 175 bp, Artificial Sequence
  Synthetic polynucleotide
atgcccacggactacatcaggaacggggtgctctacgtcacggagaattacttgtgcttcgaaagctccaaatctgggtcctcaaagaggaacaaagtcatcaagctagtggacatcacggacatccagaaggtaaatcatcatcataggagtgtggaagctgctggtacaaaat

SEQ ID NO: 330 - DNA, 3628 bp, Artificial Sequence
  Synthetic polynucleotide
atgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttact

SEQ ID NO: 331 - DNA, 3628 bp, Artificial Sequence; identical to SEQ ID NO: 330
  Synthetic polynucleotide

SEQ ID NO: 332 - DNA, 3127 bp, Artificial Sequence
  Synthetic polynucleotide
atggcaaggtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacggaaatagggaggacccaggagcacgcaaatgactccacagggatgcaggacaaccacctggagcctgatttgtttgacaaataaattgcaaggaaaaaaaaaccaacaacagatggacagaatacctgtgggttaaaagaaacttaacttatcgcttaattcattgcaatatgtggcccttact

SEQ ID NO: 333 - DNA, 819 bp, Artificial Sequence
  Synthetic polynucleotide
atggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagaacatagctgacaaattaacttcagtaaaactcaacttggatcatatgttttcttttctcaaaatcttccctaaatgggtcctcacacttaaaaggtaagtccttagtccttac

SEQ ID NO: 334 - DNA, 876 bp, Artificial Sequence
  Synthetic polynucleotide
atggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagaacatagctgacaaattaacttcagtaaaactcaacttggatcatatgttttcttttctcaaaatcttccctaaatgggtcctcacacttaaaaggtaagtccttagtccttac

SEQ ID NO: 335 - DNA, 876 bp, Artificial Sequence; identical to SEQ ID NO: 334
  Synthetic polynucleotide

SEQ ID NO: 336 - DNA, 137 bp, Artificial Sequence
  Synthetic polynucleotide
atggtgcgtgcgggcgccgtgggggctcatctccccgcgtccggcttggatatcttcggggacctgaagaagatgaacaagcgccagctttcgtgtcacctgggaatgtgtctgaagtgcagtcctcaggcatcgcc

SEQ ID NO: 337 - DNA, 137 bp, Artificial Sequence; identical to SEQ ID NO: 336
  Synthetic polynucleotide

SEQ ID NO: 338 - DNA, 137 bp, Artificial Sequence; identical to SEQ ID NO: 336
  Synthetic polynucleotide

SEQ ID NO: 339 - DNA, 451 bp, Artificial Sequence
  Synthetic polynucleotide
atggcgccatcgcccaggaccggcagccggcaagatgcgaccgccctgcccagcatgtcctcaactttctgggcgttcatgatcctggccagcctgctcatcgcctactgcaatggaattagttaagatgtggtcacacgagagttggataggccctaaatccagtgcccggtgtccttagaagatgcagagagaccctgagaccacccagaggaagacgccctgtggaaacggaggtggagatgggggtgacgggcctgctagccgaggagccgctgggtggccagccacgctggaagctggaggccacatgtttcccctggagctcccagaaggaactggccctgccaacactttgtggacttctggcccagaactgtgtgaagataattccactgtgtgagatgccgggtttgtgggattttgttatgccgacacaggccactaacac

SEQ ID NO: 340 - DNA, 451 bp, Artificial Sequence; identical to SEQ ID NO: 339
  Synthetic polynucleotide

SEQ ID NO: 341 - DNA, 3093 bp, Artificial Sequence
  Synthetic polynucleotide
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 342 - DNA, 2979 bp, Artificial Sequence
  Synthetic polynucleotide
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacgcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 343 - DNA, 3078 bp, Artificial Sequence
  Synthetic polynucleotide
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 344 - DNA, 3093 bp, Artificial Sequence; identical to SEQ ID NO: 341
  Synthetic polynucleotide

SEQ ID NO: 345 - DNA, 3078 bp, Artificial Sequence; identical to SEQ ID NO: 343
  Synthetic polynucleotide

SEQ ID NO: 346 - DNA, 3072 bp, Artificial Sequence
  Synthetic polynucleotide
atggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 347 - DNA, 1935 bp, Artificial Sequence
  Synthetic polynucleotide
ataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 348 - DNA, 1096 bp, Artificial Sequence
  Synthetic polynucleotide
tgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 349 - DNA, 902 bp, Artificial Sequence
  Synthetic polynucleotide
cgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 350 - DNA, 874 bp, Artificial Sequence
  Synthetic polynucleotide
tgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagtggtttctcccacaggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaagaagaagaaaaaaagaa

SEQ ID NO: 351 - DNA, 163 bp, Artificial Sequence
  Synthetic polynucleotide
atgccgggcatggcagcgtgtgcctgtagtcccagctactcaggaggctgaggcagaagaatttcttgaacccgggaggcagaggctgcagtgagccgagatcgcactactgcactccggcctgggcgacagagcaagactccatctccaaaaaaaaaagaaa

SEQ ID NO: 352 - DNA, 163 bp, Artificial Sequence; identical to SEQ ID NO: 351
  Synthetic polynucleotide

SEQ ID NO: 353 - DNA, 163 bp, Artificial Sequence; identical to SEQ ID NO: 351
  Synthetic polynucleotide

SEQ ID NO: 354 - DNA, 163 bp, Artificial Sequence; identical to SEQ ID NO: 351
  Synthetic polynucleotide

SEQ ID NO: 355 - DNA, 222 bp, Artificial Sequence
  Synthetic polynucleotide
gatccccggccgcggggccaggaagtcggagtttgagccccggaggcagagcggctgccatgccgggcatggcagcgtgtgcctgtagtcccagctactcaggaggctgaggcagaagaatttcttgaacccgggaggcagaggctgcagtgagccgagatcgcactactgcactccggcctgggcgacagagcaagactccatctccaaaaaaaaaagaaa

SEQ ID NO: 356 - DNA, 552 bp, Artificial Sequence
  Synthetic polynucleotide
atggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggtgttgataccaagcgcacttcctaacaaacataccacctgcctcagagtctgcttcccagggaacccaacctgcgac

SEQ ID NO: 357 - DNA, 552 bp, Artificial Sequence; identical to SEQ ID NO: 356
  Synthetic polynucleotide

SEQ ID NO: 358 - DNA, 552 bp, Artificial Sequence; identical to SEQ ID NO: 356
  Synthetic polynucleotide

SEQ ID NO: 359 - DNA, 387 bp, Artificial Sequence
  Synthetic polynucleotide
atgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgatcctctggatggaaccaaggaatataccgaaggtcttcttgacaatgtaacagttcttattggaattgcttatgaaggaaaagccatagcaggagttattaaccagccatattacaactatgaggtgttgataccaagcgcacttcctaacaaacataccacctgcctcagagtctgcttcccagggaacccaacctgcgac

SEQ ID NO: 360 - DNA, 444 bp, Artificial Sequence
  Synthetic polynucleotide
atggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagagctcgtggtctgggttgatcctctggatggaaccaaggaatataccgaaggtcttcttgacaatgtaacagttcttattggaattgcttatgaaggaaaagccatagcaggagttattaaccagccatattacaactatgaggtgttgataccaagcgcacttcctaacaaacataccacctgcctcagagtctgcttcccagggaacccaacctgcgac

SEQ ID NO: 361 - DNA, 444 bp, Artificial Sequence; identical to SEQ ID NO: 360
  Synthetic polynucleotide

SEQ ID NO: 362 - DNA, 444 bp, Artificial Sequence; identical to SEQ ID NO: 360
  Synthetic polynucleotide

SEQ ID NO: 363 - DNA, 387 bp, Artificial Sequence; identical to SEQ ID NO: 359
  Synthetic polynucleotide

SEQ ID NO: 364 - DNA, 431 bp, Artificial Sequence
  Synthetic polynucleotide
gcttccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgtccccaaatcttgctctctttggaaaaagcacagatcacagactgttcctgtggttttgtgtttctttttcctgggctctggcaaaataaacctctgacttgattgagagctgcctcagatgctttttggtttaca

SEQ ID NO: 365 - DNA, 739 bp, Artificial Sequence
  Synthetic polynucleotide
atggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatggatgggtcccaaattatacaagcttcagaccccacaaagcctg

SEQ ID NO: 366 - DNA, 865 bp, Artificial Sequence
  Synthetic polynucleotide
atgccgcggctcctccgcttgtccctgctgtggcttggactcctgctggttcggttttctcgtgaactgagcgacatcagcagtgccaggaagctgtgcggcaggtacttggtgaaagaaatagaaaaactctgcggccatgccaactggagccagttccgtttcgaggaggaaacccctttctcacggttgattgcacaggcctcggagaaggtcgaagcctacagcccataccagttcgaaagcccgcaaaccgcttccccggcccggggaagaggcacaaacccagtgtctacttcttgggaagaagcagtaaacagttgggaaatgcagtcactacctgagtataaggataaaaagggatattcaccccttgtgtgaacttgccactcccccatcaaatctggacaggcttctgacccttacaaccagtaggacatggcagaagttatactgtgcagctaccaaggctaaatcataaaagatttatgctgagacacactcacttttaattctctactcaccactatgaaaggtgaccaccctgaagccaccatattgtgaggaaatccaggccacatgtacatgctccagttaacagcccagctaacatcccagtcaagagccagcatcaactacccatcatgtgagtgaagacacctccagatgattccagtcctttgccttcaagtcacccctggctggcaattcttcccaactcatgtcctagtagccattgtggagcaaaaacaaagtcatccctggtgtgccctgtctcaattactgacccatggtatctgtgagcctaataaagtagttgttttaaatcactaagttttgggtagtttctgttacacagcaatag

SEQ ID NO: 367 - DNA, 719 bp, Artificial Sequence
  Synthetic polynucleotide
atgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcctctgagttcctt

SEQ ID NO: 368 - DNA, 719 bp, Artificial Sequence; identical to SEQ ID NO: 367
  Synthetic polynucleotide

SEQ ID NO: 369 - DNA, 716 bp, Artificial Sequence
  Synthetic polynucleotide
atgtcaggacacaaatgttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcctctgagttcctt

SEQ ID NO: 370 - DNA, 719 bp, Artificial Sequence; identical to SEQ ID NO: 367
  Synthetic polynucleotide

SEQ ID NO: 371 - DNA, 719 bp, Artificial Sequence; identical to SEQ ID NO: 367
  Synthetic polynucleotide

SEQ ID NO: 372 - DNA, 683 bp, Artificial Sequence
  Synthetic polynucleotide
atggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagcctctgagttcctt

SEQ ID NO: 373 - DNA, 719 bp, Artificial Sequence; identical to SEQ ID NO: 367
  Synthetic polynucleotide

SEQ ID NO: 374 - DNA, 719 bp, Artificial Sequence; identical to SEQ ID NO: 367
  Synthetic polynucleotide

SEQ ID NO: 375 - DNA, 683 bp, Artificial Sequence; identical to SEQ ID NO: 372
  Synthetic polynucleotide

SEQ ID NO: 376 - DNA, 5853 bp, Artificial Sequence
  Synthetic polynucleotide
atggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 377 - DNA, 5829 bp, Artificial Sequence
  Synthetic polynucleotide
atggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 378 - DNA, 1950 bp, Artificial Sequence
  Synthetic polynucleotide
atgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 379 - DNA, 2072 bp, Artificial Sequence
  Synthetic polynucleotide
gaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatatttgtctttta

SEQ ID NO: 380 - DNA, 390 bp, Artificial Sequence
  Synthetic polynucleotide
atgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaatccacagtgatcgatcaaaagagggactgaatgggagtgggtgaatggatcggtgcaaatccattaccactgctggagaaaccaccc

SEQ ID NO: 381 - DNA, 390 bp, Artificial Sequence; identical to SEQ ID NO: 380
  Synthetic polynucleotide

SEQ ID NO: 382 - DNA, 390 bp, Artificial Sequence; identical to SEQ ID NO: 380
  Synthetic polynucleotide

SEQ ID NO: 383 - DNA, 299 bp, Artificial Sequence
  Synthetic polynucleotide
gacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaatccacagtgatcgatcaaaagagggactgaatgggagtgggtgaatggatcggtgcaaatccattaccactgctggagaaaccaccc

SEQ ID NO: 384 - DNA, 150 bp, Artificial Sequence
  Synthetic polynucleotide
atgtggaaaggatgtctgacactttatactggaaggggtggtgaacttcaaaaaattggggaatccacagtgatcgatcaaaagagggactgaatgggagtgggtgaatggatcggtgcaaatccattaccactgctggagaaaccaccc

SEQ ID NO: 385 - DNA, 150 bp, Artificial Sequence; identical to SEQ ID NO: 384
  Synthetic polynucleotide

SEQ ID NO: 386 - DNA, 150 bp, Artificial Sequence; identical to SEQ ID NO: 384
  Synthetic polynucleotide

SEQ ID NO: 387 - DNA, 445 bp, Artificial Sequence
  Synthetic polynucleotide
atggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaagtcagccttcgagtcggaggtgtctgaggttgccatcagccagggcgaggtcaccctggccctcaggaaccgggcctggatgaaggacgagcgtgtgcccaagaacctggccacgcagctggactccgccttcatccggaaggagccctttggcctggtcctcatcattgcgccctggaactatccgctgaacctgacgctggtgcccctcgtgggagccctcgctgcaggttctgcatctgaaagtgggtgaggctgatgcctgccctgcaggtgtgtggaga

SEQ ID NO: 388 - DNA, 445 bp, Artificial Sequence; identical to SEQ ID NO: 387
  Synthetic polynucleotide

SEQ ID NO: 389 - DNA, 445 bp, Artificial Sequence; identical to SEQ ID NO: 387
  Synthetic polynucleotide

SEQ ID NO: 390 - DNA, 337 bp, Artificial Sequence
  Synthetic polynucleotide
atggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggccacgcagctggactccgccttcatccggaaggagccctttggcctggtcctcatcattgcgccctggaactatccgctgaacctgacgctggtgcccctcgtgggagccctcgctgcaggttctgcatctgaaagtgggtgaggctgatgcctgccctgcaggtgtgtggaga

SEQ ID NO: 391 - DNA, 910 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 392 - DNA, 997 bp, Artificial Sequence
  Synthetic polynucleotide
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 393 - DNA, 436 bp, Artificial Sequence
  Synthetic polynucleotide
atggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 394 - DNA, 997 bp, Artificial Sequence; identical to SEQ ID NO: 392
  Synthetic polynucleotide

SEQ ID NO: 395 - DNA, 1039 bp, Artificial Sequence
  Synthetic polynucleotide
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 396 - DNA, 868 bp, Artificial Sequence
  Synthetic polynucleotide
atggcccagcgtaagaatgccaagagcagcggcaacagcagcagcagcggctccggcagcggtagcacgagtgcgggcagcagcagccccggggcccggagagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 397 - DNA, 952 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 398 - DNA, 955 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgttgagggagaagacttgcaacaagaagatggacccacaggagaaccacaacaagaggatgatgagtttcttatggcgactgatgtagatgatagatttgagaccctggaacctgaagtatctcatgaagaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 399 - DNA, 955 bp, Artificial Sequence; identical to SEQ ID NO: 398
  Synthetic polynucleotide

SEQ ID NO: 400 - DNA, 826 bp, Artificial Sequence
  Synthetic polynucleotide
atggctgaagataaagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctagccaaagcaaaggacttccgttataacttatcagaggtgcttcaaggaaaactaggaatctatgatgctgatggtgatggagattttgatgtggatgatgccaaagttttattaggacttaaagagagatctacttcagagccagcagtcccgccagaagaggctgagccacacactgagcccgaggagcaggttcctgtggaggcagaaccccagaatatcgaagatgaagcaaaagaacaaattcagtcccttctccatgaaatggtacacgcagaacatgaaaccgagcatagttaccacgtggaagagacagtttcacaagactgtaatcaggatatggaagagatgatgtctgagcaggaaaatccagattccagtgaaccagtagtagaagatgaaagattgcaccatgatacagatgatgtaacataccaagtctatgaggaacaagcagtatatgaacctctagaaaatgaagggatagaaatcacagaagtaactgctccccctgaggataatcctgtagaagattcacaggtaattgtagaagaagtaagcatttttcctgtggaagaacagcaggaagtaccaccaggaggaccagtcttcagtcaagggtatatgagtagcacccctgctggaacctccaaacaagatc

SEQ ID NO: 401 - DNA, 586 bp, Artificial Sequence
  Synthetic polynucleotide
atggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 402 - DNA, 829 bp, Artificial Sequence
  Synthetic polynucleotide
atggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 403 - DNA, 1060 bp, Artificial Sequence
  Synthetic polynucleotide
atggctgtgtttaatcagaagtctgtctcggatatgattaaagagtttcgaaaaaattggcgtgctctttgtaactctgagagaactactctatgtggtgcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctgggtcaactatacagccaccttcagaaagaggaagcttgctgctgtctaggccagatctcttggctcctggggaagatccaccagtgtcagcctcattgactctggagcggcagaagggagagtccctcttagcatggagctggtccctaaacttcagattgcctgggattcccatcacggtccagaagaagagacgagacctgaagaagctggcagctgtcatgcggcaaagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 404 - DNA, 829 bp, Artificial Sequence; identical to SEQ ID NO: 402
  Synthetic polynucleotide

SEQ ID NO: 405 - DNA, 586 bp, Artificial Sequence; identical to SEQ ID NO: 401
  Synthetic polynucleotide

SEQ ID NO: 406 - DNA, 730 bp, Artificial Sequence
  Synthetic polynucleotide
gcagactccatgctcttggcattgcagctttctatggcggagaacaacaaacagcacagtggagaatttacagtctctctcagtgatgttttattgacatggaaatacttgctccatgagaaattgaacttaccagttgaaaacatggacgtgactgaccattatgaggacgttaggaagatttatgatgatttcttgaagaacagtaatatgttagatctgattgatgtttatcaaaaatgtagggctttgacttctaattgtgaaaattataacacagtatctcctagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 407 - DNA, 730 bp, Artificial Sequence; identical to SEQ ID NO: 406
  Synthetic polynucleotide

SEQ ID NO: 408 - DNA, 496 bp, Artificial Sequence
  Synthetic polynucleotide
gcagactccatgctcttggcattgcagctttctatggcggagaacaacaaacagagtcaactactggattttctgtctggcaaacagtatgcagtaggtgatgaaactgatctttctataccaacatcaccaacaagtaaatacaaccgtgataatgaaaaggccctcccagtcctgaagagataactgagagtctagcaccttttaataggaagcatttgccatctattgtttctaagggtggccacctatgagacgtcatctacataataagaaccttggtcttcacaatcccatatcttaaaccagagactcctttctactgattccaggtctttagataataattctttcaaccaattgcttgccaatcagaaaatctttgaatctacctatgacctataagccccatttcaaggtgtcccacctttccaggctgaaccaatctttacctcacatgtactgattgatgtcttatgtctctctaaaacatata

SEQ ID NO: 409 - DNA, 441 bp, Artificial Sequence
  Synthetic polynucleotide
atgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcccctgggggacagagcgagactttgcctcgaaaaaagaaaaagaa

SEQ ID NO: 410 - DNA, 392 bp, Artificial Sequence
  Synthetic polynucleotide
atgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagaa

SEQ ID NO: 411 - DNA, 392 bp, Artificial Sequence; identical to SEQ ID NO: 410
  Synthetic polynucleotide

SEQ ID NO: 412 - DNA, 392 bp, Artificial Sequence; identical to SEQ ID NO: 410
  Synthetic polynucleotide

SEQ ID NO: 413 - DNA, 392 bp, Artificial Sequence; identical to SEQ ID NO: 410
  Synthetic polynucleotide

SEQ ID NO: 414 - DNA, 721 bp, Artificial Sequence
  Synthetic polynucleotide
atggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaa

SEQ ID NO: 415 - DNA, 721 bp, Artificial Sequence; identical to SEQ ID NO: 414
  Synthetic polynucleotide

SEQ ID NO: 416 - DNA, 721 bp, Artificial Sequence; identical to SEQ ID NO: 414
  Synthetic polynucleotide

SEQ ID NO: 417 - DNA, 721 bp, Artificial Sequence; identical to SEQ ID NO: 414
  Synthetic polynucleotide

SEQ ID NO: 418 - DNA, 721 bp, Artificial Sequence; identical to SEQ ID NO: 414
  Synthetic polynucleotide

SEQ ID NO: 419 - DNA, 721 bp, Artificial Sequence; identical to SEQ ID NO: 414
  Synthetic polynucleotide

SEQ ID NO: 420 - DNA, 721 bp, Artificial Sequence; identical to SEQ ID NO: 414
  Synthetic polynucleotide

SEQ ID NO: 421 - DNA, 721 bp, Artificial Sequence; identical to SEQ ID NO: 414
  Synthetic polynucleotide

SEQ ID NO: 422 - DNA, 1332 bp, Artificial Sequence
  Synthetic polynucleotide
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggaaatacatttcataagtctacagctaccatggtgacttgtctgaagaacctgggaaaagaaaattgaaaatcttctgaaaaagatttactattctagatgccattaaaaacattcatgattcgtgacaggagggcaaaacatttacttgaacaggagtttgaaagaagtgaattcaaccctcctggatgacttggaggaatgcaagatttcagtggagaaagtaattgcagatgtggtggaaatagcaagacaactagaattcaaattggagcttgcaagttactgaatgcttgcaatctcatgatgtaattttaacaaaggagaagtgtttcttatggatgagcaagaaaagtggtttggtgaaatggatttcatttcttaggaaaccgttgtaaacactgttggaaaggcagcgaaggattcagaatattacagaagcatagttgataaggccatgacagtgtttgagagaattctctctaat

SEQ ID NO: 423 - DNA, 1254 bp, Artificial Sequence
  Synthetic polynucleotide
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggaaatacatttcataagtctacagctaccatggtgacttgtctgaagaacctgggaaaagaaaattgaaaatcttctgaaaaagatttactattctagatgccattaaaaacattcatgattcgtgacaggagggcaaaacatttacttgaacaggagtttgaaagaagtgaattcaaccctcctggatgacttggaggaatgcaagatttcagtggagaaagtaattgcagatgtggtggaaatagcaagacaactagaattcaaattggagcttgcaagttactgaatgcttgcaatctcatgatgtaattttaacaaaggagaagtgtttcttatggatgagcaagaaaagtggtttggtgaaatggatttcatttcttaggaaaccgttgtaaacactgttggaaaggcagcgaaggattcagaatattacagaagcatagttgataaggccatgacagtgtttgagagaattctctctaat

SEQ ID NO: 424 - DNA, 1332 bp, Artificial Sequence; identical to SEQ ID NO: 422
  Synthetic polynucleotide

SEQ ID NO: 425 - DNA, 1290 bp, Artificial Sequence
  Synthetic polynucleotide
atggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcgggcccgcaggtggggaacgctctgggcagcctggagccactgcgctggatgctgcgctcgcccttcgaccgcaacgtgccggtcaacctggagcttcaggagttgctgctggactacagcttccagcacctgggtgtctcctcacagggctgtgttgatcatcccatagttttgacagaagctgtgtgcaacccactgtattcacggcaaatgatgtctgagcttctttttgagtgctacgggattcccaaggttgcctatggaatagacagcctcttcagcttctaccacaataagccaaagaactcgatgtgcagtgggctaatcatttcatctggataccagtgtacgcatgttttacccatcttagaagggagattagatgctaaaaactgcaagcgcatcaatcttggaggaagccaagcagctggttacctccagcgtctcctccagctgaagtaccctgggcacctggcagccatcaccctcagccgcatggaggagattctgcatgagcacagctacatcgctgaggattatgtggaagaattacacaaatggcggtgtcctgattattatgagaataatgtccacaagatgcagctcccattttccagcaagctcctgggcagcactctgacctctgaggagaaacaagaaaggcggcagcagcaattgcggcggctgcaggagctcaatgcccggcggcgggaggagaagctgcagctggatcaggagcgtctggaccgactgctatatgtgcaggaacttctagaggatggccagatggatcagtttcacaaagctctgatagagctgaatatggactccccagaagagctgcagtcctacatccagaagctcagtatagcagtggagcaggctaagcagaaaatcctccaagcggaagtcaacctcgaggtggatgtggtagacagcaagccagagctgcatgcttggtcgaagaggacgaccatccccaatagaggaggactgatcttccgtcaagagtatacgagtagctgcgctcccctgctagaacctccaaacaagcgctcaagg

SEQ ID NO: 426 - DNA, 569 bp, Artificial Sequence
  Synthetic polynucleotide
atgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggtgttgatcccaagaacattccataattaacaggctggatgccgatctccgtctcaaagtcatcttcccaggaaacccaactggcaata

SEQ ID NO: 427 - DNA, 247 bp, Artificial Sequence
  Synthetic polynucleotide
atggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggaaaataatcgactgaaaatcttccttaagaagc

SEQ ID NO: 428 - DNA, 3308 bp, Artificial Sequence
  Synthetic polynucleotide
atgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 429 - DNA, 3203 bp, Artificial Sequence
  Synthetic polynucleotide
atggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 430 - DNA, 2849 bp, Artificial Sequence
  Synthetic polynucleotide
atggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 431 - DNA, 388 bp, Artificial Sequence
  Synthetic polynucleotide
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagacccccaggaacaaaatataacagagtagtgtaaaagtttgtcctctcc

SEQ ID NO: 432 - DNA, 1188 bp, Artificial Sequence
  Synthetic polynucleotide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaaattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 433 - DNA, 1111 bp, Artificial Sequence
  Synthetic polynucleotide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 434 - DNA, 382 bp, Artificial Sequence
  Synthetic polynucleotide
ctagaatgtaagttccatgaaggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataa

SEQ ID NO: 435 - DNA, 382 bp, Artificial Sequence; identical to SEQ ID NO: 434
  Synthetic polynucleotide

SEQ ID NO: 436 - DNA, 1148 bp, Artificial Sequence
  Synthetic polynucleotide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaaattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 437 - DNA, 871 bp, Artificial Sequence
  Synthetic polynucleotide
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 438 - DNA, 871 bp, Artificial Sequence; identical to SEQ ID NO: 437
  Synthetic polynucleotide

SEQ ID NO: 439 - DNA, 871 bp, Artificial Sequence; identical to SEQ ID NO: 437
  Synthetic polynucleotide

SEQ ID NO: 440 - DNA, 871 bp, Artificial Sequence; identical to SEQ ID NO: 437
  Synthetic polynucleotide

SEQ ID NO: 441 - DNA, 421 bp, Artificial Sequence
  Synthetic polynucleotide
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggcc

SEQ ID NO: 442 - DNA, 638 bp, Artificial Sequence
  Synthetic polynucleotide
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggc

SEQ ID NO: 443 - DNA, 337 bp, Artificial Sequence
  Synthetic polynucleotide
ggctgggtgcagtggctgacacgtgtaatcccagcacttcaggaggctgaggcaggctggtcacctgaggtcaggagttcgagaccagtctggccaacatggtgaaacccccgtctctactaaaaatacaaaaattagccaggcgtggtagtgcacacctgtaatcacagctactcaggaggctgcggcaagagaatcacttgaacccgggaggcagaggttacagcgagacaagattgcaccactggactccagcctgggcggcggaggtgaaattgctcaaataatggagcaaggtgacctctcagtgagagatgctgccgtcgacactctgtaa

SEQ ID NO: 444 - DNA, 1086 bp, Artificial Sequence
  Synthetic polynucleotide
agcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctga

SEQ ID NO: 445 - DNA, 564 bp, Artificial Sequence
  Synthetic polynucleotide
agcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaagttcttccagaaggcagcactgaacgtgcgagacaatgttggggaggaggtggacgcagagcagctgatccaggaagcctgtcggagctgcctggagcaggtgcgtggtggatcaagttatcatggccccatttggtatcatggggatgagcaccctgctgcctccctgcctctctggtgtggtcaggaagcatga

SEQ ID NO: 446 - DNA, 987 bp, Artificial Sequence
  Synthetic polynucleotide
agcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcgaacccttggaacataatgataaagcaccggcaggtgcagcggaggggccgccgctcacagatgacaacaagtttcacagatcctgccatctccatggatctcctccgagctgtcctgcagcccagcatcaacgaggagatccagactgtcttcaacaagtacatgaaggctaaactgctcttttcagatggagaaaaagtaatacccagattgacccatgagcttccaggaataaagcgtggccgtcaggcagaagaagaatgtgcccatcgaggaagcccccttcctaaaaagaggaaaggacggcctcctggacacatcctgtcaagcgaccgggcagccgccggcatggtatggaaaccaaaatcctgtgaaccaattcgccgggaaggccccaagtgggacccagctcgcctgaatgaatctaccacctttgtgttgggatctcgagccaacaaagccctggggatggggggcaccagaggaagaatctacatcaagcacccacacctctttaagtatgcagctgacccccaggataagcactggctggctgagcagcatcacatgcgggcaacagggggcaagatggcctacctcctcatcgaggaggacatccgggaccttgcggccagtgatgattacagaggatgcctggatctgaagctagaggaattgaaatcctttgtcctaccctcctggatggtggagaagatgagaaagtatatggagacactacggacagagaatgagcatcgtgctgttgaagcacctccacagacctga

SEQ ID NO: 447 - DNA, 1052 bp, Artificial Sequence
  Synthetic polynucleotide
caggatcctgaggtgagtgaccctttggtcccccctgattccgggtcggccatgaggctgcagcgtgggttgtggtacctggtagcagctgtgctgtttggatgggctttggtggaaacctgggtggcgatagatgggtcccctgcaagcatggagaaggctctgaagctgctggaagcacagagcactgagaaggagtgagcttttgctggtagagttggatgggcattttgactgtgctatgagaagcacacacccagtccctgagggatgcagtgcaggtaagcgcccttcaggcagaggtggggcacctggaaacccagctacagagcttggaaaaggaattagaggctgctgtgaatgtaggcatgggtccattgtctcagccagagatccccacttggtctgatacagagaaagaagaactcttgttgtgggctcacccagtggtccaccagaaggtagatcatgaacagctgttggggccccaagagaaggctcagggacccccccccacccaccgtaatgcaacatacttcatatactgcctataccccaactgagttgtgggaattaggcaagcagtgccgccagcatccaggggaatgtctacctgcctggatgcttcatttgtgagacaagagagcagatagtatctcctgttctgcctctgagatggaaaagctggcctctatcacgactcacccctccctctgtcagtggttgcaggtgaacaagcagttggcacaagggcaaagtgatcacatcctgattgagtggctatggacagccatacagactgtgtggaacaacgctggtgaaatacccaaacctctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactga

SEQ ID NO: 448 - DNA, 1118 bp, Artificial Sequence
  Synthetic polynucleotide
caggatcctgaggtgagtgaccctttggtcccccctgattccgggtcggccatgaggctgcagcgtgggttgtggtacctggtagcagctgtgctgtttggatgggctttggtggaaacctgggtggcgatagatgggtcccctgcaagcatggagaaggctctgaagctgctggaagcacagagcactgagaaggagtgagcttttgctggtagagttggatgggcattttgactgtgctatgagaagcacacacccagtccctgagggatgcagtgcaggtaagcgcccttcaggcagaggtggggcacctggaaacccagctacagagcttggaaaaggaattagaggctgctgtgaatgtaggcatgggtccattgtctcagccagagatccccacttggtctgatacagagaaagaagaactcttgttgtgggctcacccagtggtccaccagaaggtagatcatgaacagctgttggggccccaagagaaggctcagggacccccccccacccaccgtaatgcaacatacttcatatactgcctataccccaactgagttgtgggaattaggcaagcagtgccgccagcatccaggggaatgtctacctgcctggatgcttcatttgtgagacaagagagcagatagtatctcctgttctgcctctgagatggaaaagctggcctctatcacgactcacccctccctctgtcagtggttgcaggtgaacaagcagttggcacaagggcaaagtgatcacatcctgattgagtggctatggacagccatacagactgtgtggaacaacgctggtgaaatacccaaacctctccagagaatacagagggcaaagatggatccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggtactgcaccatctgaaaatggtgaaactaaagctgaagaggcacagaaaactgaatctgtagataacgagggagaatga

SEQ ID NO: 449 - DNA, 3021 bp, Artificial Sequence
  Synthetic polynucleotide
gaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatag

SEQ ID NO: 450 - DNA, 3075 bp, Artificial Sequence
  Synthetic polynucleotide
gaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatag

SEQ ID NO: 451 - DNA, 1143 bp, Artificial Sequence
  Synthetic polynucleotide
gaccctggagccagagagcctaggcttagtcctagccctgcactgaagacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattaggcatgtcaacatcgctctaattcagagataa

SEQ ID NO: 452 - DNA, 347 bp, Artificial Sequence
  Synthetic polynucleotide
ccccagaaaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctag

SEQ ID NO: 453 - DNA, 347 bp, Artificial Sequence; identical to SEQ ID NO: 452
  Synthetic polynucleotide

SEQ ID NO: 454 - DNA, 148 bp, Artificial Sequence
  Synthetic polynucleotide
ccccagaaaggaatttggccattggaatcgggatccagaatttccccgagggcctggctgtcagccttcccttgcgaggggcaggcttctccacctggagagctttctggtatgggcagctgagcggcatggtggagcccctggccgg

SEQ ID NO: 455 - DNA, 594 bp, Artificial Sequence
  Synthetic polynucleotide
ttcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaaca

SEQ ID NO: 456 - DNA, 1031 bp, Artificial Sequence
  Synthetic polynucleotide
ttcctggctgcccaatgtggggcaatgaagaccccagtgaaggaatgctagagtgtgtgaaagtggaggacgcatcgtcaaaggacacctgaggacgtctcaaagaagctcggcgggagagctgagcgctcggaagaaccaaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaa

SEQ ID NO: 457 - DNA, 1031 bp, Artificial Sequence; identical to SEQ ID NO: 456
  Synthetic polynucleotide

SEQ ID NO: 458 - DNA, 1142 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 459 - DNA, 1064 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 460 - DNA, 1142 bp, Artificial Sequence; identical to SEQ ID NO: 458
  Synthetic polynucleotide

SEQ ID NO: 461 - DNA, 772 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 462 - DNA, 590 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 463 - DNA, 1267 bp, Artificial Sequence
  Synthetic polynucleotide
ggccaggtgcagtggcttatgcctgaaatcccagcactttgggaggctgaggcaggcagatcacctgaggtcaggagttcaagaccagactggccaacatgaagaaaccccgtctctactagccaggcgtggtggtgtgagcctgtagtcccagctactcgggaggctgaggcacaagaatcacttgaacccaggaggcagaggttgcagtgaactgaaatcgcaccattgcgctccagcctgggtgacagagatcaacggccaccccgggaagtccacgcgcctggcgggcttgtggaagctggaagagtgccacgccagcggctgcatgatggacctcttcgtgcagatggccatcatcatgggcctgaagcagacgctcagcaactgcgtcgagtacctggtcccgtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgatgatccagtacggcttcaccaccatcttcgtggccgccttcccgctggcgccgctgctcgcgctcttcagcaacctcgtggagatccgcctggacgccatcaagatggtctggttgcagcggcgcctggtgccgcgcaaggccaaggacatcgggacctggctgcaggtgctggagaccatcggtgtgctggcggtcattgccaatgggatggtcattgccttcacatctgagttcatcccccgagtggtctacaagtaccgctatagcccatgcctgaaagaaggcaactctactgtcgactgcctcaagggctacgtcaaccacagcctgtccgtcttccacaccaaggacttccaggaccctgatgggattgagggctcagaaaacgtgactctgtgcagatacagggactaccgcaatccccccgattacaacttctccgagcagttctggttcctcctggccatccgcctggccttcgtcatcctctttgagcacgtggccttgtgcatcaagctcatcgccgcctggttcgtgcccgacatccctcagtcggtgaagaacaaggttctggaggtgaagtaccagaggctgcgtgagaagatgtggcatggaaggcagaggctgggtggggtgggggcaggctctcggcccccaatgcctgcccatcccaccccagcatccatcttcagtgccaggagcacagacgtgtag

SEQ ID NO: 464 - DNA, 7329 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 465 - DNA, 7320 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 466 - DNA, 201 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgccctgtgtgtccaaatgctgggagaacatcaccccttggatga

SEQ ID NO: 467 - DNA, 165 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttccctgtgtgtccaaatgctgggagaacatcaccccttggatga

SEQ ID NO: 468 - DNA, 129 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttcaactga

SEQ ID NO: 469 - DNA, 201 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttgtgcagaagcagtgattgtgactgggtaatagacaagagaagtgagagaaactgctttctaggcaagatgctgttatga

SEQ ID NO: 470 - DNA, 270 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacggagcctgagtccaaccccatccagcccaggcagtccttgtagtcctctcttggcctttcacttttggagccctgtgtgtccaaatgctgggagaacatcaccccttggatga

SEQ ID NO: 471 - DNA, 201 bp, Artificial Sequence; identical to SEQ ID NO: 469
  Synthetic polynucleotide

SEQ ID NO: 472 - DNA, 1104 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaaggtgagtccctgggttgttcctacctttga

SEQ ID NO: 473 - DNA, 7356 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 474 - DNA, 246 bp, Artificial Sequence
  Synthetic polynucleotide
aactcctatttctgagatttcctttaccacttaggaggtagactatgaccagggaccattgctctcactcctacagtcaaaataacctggaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagggaatga

SEQ ID NO: 475 - DNA, 1201 bp, Artificial Sequence
  Synthetic polynucleotide
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatgagagcagcacttgaggcatgtcacaagggctggggcgtcagcgtcgtggttggagtagctgcttcaggtgaagaaattgccactcgtccattccagctggtaacaggtcgcacatggaaaggcactgcctttggaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagagcattcgaactgttgtaaagatttaa

SEQ ID NO: 476 - DNA, 247 bp, Artificial Sequence
  Synthetic polynucleotide
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaaggtgacactgtcatcccactttacatcccacagtgtggagaatgcaaattttgtctaa

SEQ ID NO: 477 - DNA, 874 bp, Artificial Sequence
  Synthetic polynucleotide
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgacactgtcatcccactttacatcccacagtgtggagaatgcaaattttgtctaaatcctaaaactaacctttgccagaagataagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatg

SEQ ID NO: 478 - DNA, 364 bp, Artificial Sequence
  Synthetic polynucleotide
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcggtgtggagaatgcaaattttgtctaaatcctaa

SEQ ID NO: 479 - DNA, 424 bp, Artificial Sequence
  Synthetic polynucleotide
ccaagatggctgaataggaacagctccagtctacagctcccagcgtgagtgacacagaagacgaatgatttctgcatttccaaatgaggttatcaagtgcaaggctgcagttgcttgggaggctggaaagcctctctccatagaggagatagaggtggcacccccaaaggctcatgaagttcgaatcaagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtgacactgtcatcccactttacatcccacagtgtggagaatgcaaattttgtctaaatcctaaaactaacctttgccagaagataagataa

SEQ ID NO: 480 - DNA, 163 bp, Artificial Sequence
  Synthetic polynucleotide
ggccaggtgcaatgggtcaagcctgcaatccccacaccaaggtgggagtattgcttgaaaccaggagttcaagaccagcctaggcaagaaagcttttatcttgagaacatggtgtctggagttaaaggtattggcatactccacacatctgtaccattcttga

SEQ ID NO: 481 - DNA, 104 bp, Artificial Sequence
  Synthetic polynucleotide
ggccaggtgcaatgggtcaagcctgcaatccccacaccaaggtgggagtattgcttgaaaccaggagttcaagaccagcctaggcaagaaagcttttatcttga

SEQ ID NO: 482 - DNA, 721 bp, Artificial Sequence
  Synthetic polynucleotide
tgatagaaaaattgggggaaagatgtgaccagataattcaccaaaacacgttttaaaaatcatcctcaagcagatgagaaaaacgctgaaactcacctcctcattataaacatgctagttgtaacaacactaggacaccatttctgacctatcagtggggaaaatgtaaaactgtgaaattatactctgtgatgaggatatggagaaatggctctctcataccttgctggtgggcatgcaaattggtacaacccttctggagagaaatttggcaatatctaataaaagtacatacgcatttcctttttgatccaggaaacccactcctaagaatctaccctaaagatacacctccaagaatatgaaactacgtagacacacaaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctag

SEQ ID NO: 483 - DNA, 721 bp, Artificial Sequence; identical to SEQ ID NO: 482
  Synthetic polynucleotide

SEQ ID NO: 484 - DNA, 522 bp, Artificial Sequence
  Synthetic polynucleotide
tgatagaaaaattgggggaaagatgtgaccagataattcaccaaaacacgttttaaaaatcatcctcaagcagatgagaaaaacgctgaaactcacctcctcattataaacatgctagttgtaacaacactaggacaccatttctgacctatcagtggggaaaatgtaaaactgtgaaattatactctgtgatgaggatatggagaaatggctctctcataccttgctggtgggcatgcaaattggtacaacccttctggagagaaatttggcaatatctaataaaagtacatacgcatttcctttttgatccaggaaacccactcctaagaatctaccctaaagatacacctccaagaatatgaaactacgtagacacacaaggaatttggccattggaatcgggatccagaatttccccgagggcctggctgtcagccttcccttgcgaggggcaggcttctccacctggagagctttctggtatgggcagctgagcggcatggtggagcccctggccgg

SEQ ID NO: 485 - DNA, 299 bp, Artificial Sequence
  Synthetic polynucleotide
tagatgaatggaacaaactggaaactccagaaacaagcccttctttacatttctaatgtttggcttaaatggaaggtgccaaggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactga

SEQ ID NO: 486 - DNA, 299 bp, Artificial Sequence; identical to SEQ ID NO: 485
  Synthetic polynucleotide

SEQ ID NO: 487 - DNA, 239 bp, Artificial Sequence
  Synthetic polynucleotide
ggctgggcacgatggctccacaccggtaatcccagcactttgggaggctgagacacagccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctga

SEQ ID NO: 488 - DNA, 239 bp, Artificial Sequence; identical to SEQ ID NO: 487
  Synthetic polynucleotide

SEQ ID NO: 489 - DNA, 750 bp, Artificial Sequence
  Synthetic polynucleotide
ttctcgcaccatgagctcacttcgtgtctccacgtcacatgttgggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattag

SEQ ID NO: 490 - DNA, 750 bp, Artificial Sequence; identical to SEQ ID NO: 489
  Synthetic polynucleotide

SEQ ID NO: 491 - DNA, 38 bp, Artificial Sequence
  Synthetic polynucleotide
tgttaaaacggagataccttcccggatgcagatgctga

SEQ ID NO: 492 - DNA, 249 bp, Artificial Sequence
  Synthetic polynucleotide
tgttaaaacggagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctag

SEQ ID NO: 493 - DNA, 503 bp, Artificial Sequence
  Synthetic polynucleotide
gatgaggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 494 - DNA, 503 bp, Artificial Sequence; identical to SEQ ID NO: 493
  Synthetic polynucleotide

SEQ ID NO: 495 - DNA, 476 bp, Artificial Sequence
  Synthetic polynucleotide
gatgaggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatggcatcacaaaaaaatgtgaaggagaagaaattttcctaggtcagtttatatataacaaaacaggaaccaccgttcaaacatttgaactccagggtccatggcacaccaggcaagcacatctagaagagttggtacagaaggccatgccacatgtccagaatattcaagaatgcttattctcttag

SEQ ID NO: 496 - DNA, 539 bp, Artificial Sequence
  Synthetic polynucleotide
gatgaggagcctccatcattgaagctgggacctcagaaagttataaaaataataaagcaaaattgtactggcatgggataggtttcctaaatcatgaaatgcctccagatattattcttcagccggatgtctaccctggaaagtgctgggcttttccaggttcccagggtcataccctaatcaagcttgctacaaagatcataccaactgctgttaccatggagcacatctcagagaaggtgtctccgtcaggaaacatctccagtgcacccaaggaattttctgtctatgttcagaggtatatgtgcaggtttgttatacaggcgggcatcacaaaaaaatgtgaaggagaagaaattttcctaggtcagtttatatataacaaaacaggaaccaccgttcaaacatttgaactccagcatgcagtttctgaatatttattatgtgtgaaacttaatatctttagcaactggggacacccgaagtatacttgtttatatcgattcagggtccatggcacaccaggcaagcacatctag

SEQ ID NO: 497 - DNA, 503 bp, Artificial Sequence; identical to SEQ ID NO: 493
  Synthetic polynucleotide

SEQ ID NO: 498 - DNA, 503 bp, Artificial Sequence; identical to SEQ ID NO: 493
  Synthetic polynucleotide

SEQ ID NO: 499 - DNA, 539 bp, Artificial Sequence; identical to SEQ ID NO: 496
  Synthetic polynucleotide

SEQ ID NO: 500 - DNA, 566 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaaggtgagggctggggactgggaggaggtcatcccttatgtccttgacttcaatcaagggcctctggcattctcccgaggaagggcttcttatttccttccagccatgacattagaggaggtgtgtgatggggtcagtaagacccttgattctaggaagacaggaatatggcatgaaaagtga

SEQ ID NO: 501 - DNA, 1523 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 502 - DNA, 1544 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 503 - DNA, 1544 bp, Artificial Sequence; identical to SEQ ID NO: 502
  Synthetic polynucleotide

SEQ ID NO: 504 - DNA, 1493 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaggagcacgccaggatacgaaggtgaaggagaaggtgacaagaacatctccaggaagccaggcaatgtgttgaagaccttagaccccatcctcatcaccatcatagccatgagtgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 505 - DNA, 602 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggtggcaccactgtgctggccacagaaaagcccacggtcatagacagcaccatacaatcaggtatcaaataa

SEQ ID NO: 506 - DNA, 707 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcaggtatcaaataa

SEQ ID NO: 507 - DNA, 887 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtgcagaaaccatcttcatcccattgctgtaccatttcagttcatgtcttagttgggaccagctaacgcctgtgtgtgtgcttgtaactccgcatggcagagagctgcccaggaatagaagctgccttgccagaacacgtgcatcttcatttcctcatgtcatctggatagatgagttgttcttaatagccacaaccatttgtaacaataatttgagccatttcgagagccaaaggctaggattatcttaa

SEQ ID NO: 508 - DNA, 698 bp, Artificial Sequence
  Synthetic polynucleotide
ggctggatatggtggctcaagcctgtgaccccagcactttgggaggccaaaatgattatccttgctctggaatgttgggtatggtgtctggacttatttctgactcccagatcacatcatccaaccaaggggacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaaggcactatcaacacagaccaagaatgtccatgtgccagggctttggcaaaggatgccaagaaaaagaagagatgggcagactccactcactgcagatgcgttcgttcaattcacggagaaatgtggtcatctggaaaaggagtctgctccctggatgcgaatctgtag

SEQ ID NO: 509 - DNA, 1477 bp, Artificial Sequence
  Synthetic polynucleotide
agatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 510 - DNA, 1369 bp, Artificial Sequence
  Synthetic polynucleotide
agatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 511 - DNA, 709 bp, Artificial Sequence
  Synthetic polynucleotide
agatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctc

SEQ ID NO: 512 - DNA, 2850 bp, Artificial Sequence
  Synthetic polynucleotide
tgatatgctttggttatgtccccactcaaatctcatcttgaattgtacgtagctcccatgattcccacatgtggtgggagagactggtgggaggtaattaaatcatagggggcgggtctttcccatgctgttcttgtgatagtgagtaagtcacatgagatctgatggttttataaggggaagttcccctacataagctctcttgcctgtcaccatgtaagatgtggctttgttcctgcttcaccttcctccatgattatgaggtctccccagcactgtggaactggcaacgctcaaaaaggagaagctggagaaagaggtccagggggaattcctgggtacaagggtgacaagggtgaacgtggggaatgtggtaaaccagggataaaaggtgacaagggatccccagggccatatggaccaaagggacccagaggaattcagggaattactggacctccaggagacccaggcccaaaggggtttcaaggcaataagggtgagccaggtcctcctggtccttatggttctccaggagctcctggaattggacagcaaggtattaagggagaaagaggccaagaaggaagaccgggagctccaggacccattggagttggtgagcctggacagccaggtccccgtggtcctgagggagtaccaggagagaggggcttacccggagaaggatttccaggaccaaagggtgaaaaaggttctgaaggaccaactggcccacagggattacaaggcctgtcaatcaaaggggagaagggggatataggacctgtgggaccccaaggaccaatgggtatccctggaatcgggagtcaaggggaacagggaatccaaggtcctattggtccacctggtccacaagggcccgcaggacagggcttacctggttccaagggagaagtaggccaaatgggacctacaggccctcgaggaccagtgggaattggagtacaaggtccaaagggagagccaggctcaatagggctcccaggacaaccaggagtaccaggagaagatggagctgcagggaagaagggagaagcggggcttccgggagcaagaggcccagaaggaccacctggaaaaggacagcctggccccaagggtgacgaaggcaagaaagggagcaaaggaaatcaaggacagaggggacttccagggcccgaaggaccaaagggtgaaccgggcattatgggcccttttggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagggagagcctggggtcagaggccctccaggtccttctgggcctcggggcgtaggaacccaagggccaaagggtgatactgggcagaaaggcttgcctggccctcctggcccccctggctatggatcacagggaattaaaggggaacaaggaccacaaggcttcccaggcccaaagggcacaatgggccatggcctcccaggccagaagggagagcacggagaacggggcgatgtgggaaagaaaggtgataaaggagaaattggagagcctggatctccaggaaaacagggtttacaaggacccaaaggagacctaggacttacaaaagaagaaattatcaaacttattacagaaatatgtggttgtgggcccaaatgcaaagagactccactagagctggtgtttgtgatcgacagctcagaaagcgtggggccagagaactttcagatcattaaaaattttgtgaagactatggctgaccgggttgctctggaccttgccacggcccgcataggcataatcaactatagccataaggtggagaaggtggctaatttgaagcagttctccagcaaggatgacttcaagttggctgtggacaacatgcagtatctgggggaaggcacatacacagccactgctctgcaagcagccaacgacatgtttgaagatgcaaggccaggtgtaaaaaaagtggccttggtcatcactgatggacagacagattctcgtgataaagagaaactgacagaggtggtgaagaatgccagtgacaccaatgtggagatatttgtgataggggtggtgaagaaaaatgatcccaactttgaaatattccacaaagaaatgaatctaattgctactgacccagagcatgtttaccagtttgatgatttctttaccctgcaagacaccctgaagcaaaaattgtttcaaaaaatttgtgaggattttgattcctatctcgttcaaatttttggttcatcgtcacctcaacctggatttgggatgtcaggggaagaactcagtgaatctactccagagcctcaaaaagaaatttctgagtcattgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatga

SEQ ID NO: 513 - DNA, 477 bp, Artificial Sequence
  Synthetic polynucleotide
tgatatgctttggttatgtccccactcaaatctcatcttgaattgtacgtagctcccatgattcccacatgtggtgggagagactggtgggaggtaattaaatcatagggggcgggtctttcccatgctgttcttgtgatagtgagtaagtcacatgagatctgatggttttataaggggaagttcccctacataagctctcttgcctgtcaccatgtaagatgtggctttgttcctgcttcaccttcctccatgattatgaggtctccccagcactgtggaactggcaacgctcaaaaaggagaagctggagaaagaggtccagggggaattcctgggtacaagggtgacaagcaatattctagggaagacagggaagtagagcataataatgaaaaatatgtagcatgcttgctgccaagcccggctctcctacagcagtcctcgctaactcatcatggcacctgttcccactaa

SEQ ID NO: 514 - DNA, 2158 bp, Artificial Sequence
  Synthetic polynucleotide
taagtaggggaagagacaacacacacccaaaatggcaagaatccgctggcacggacaggctggacccaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataa

SEQ ID NO: 515 - DNA, 124 bp, Artificial Sequence
  Synthetic polynucleotide
taagtaggggaagagacaacacacacccaaaatggcaagaatccgctggcacggacaggctggacccaggacatgggtgtggaggcaaagaaccatgaagtacacaacagccacaggcagatga

SEQ ID NO: 516 - DNA, 166 bp, Artificial Sequence
  Synthetic polynucleotide
taagtaggggaagagacaacacacacccaaaatggcaagaatccgctggcacggacaggctggacccaggacatgggtgtggaggcaaagaaccatgaagtacacaacagccacaggctatccatccaggatgcggttttctctcagaaaacatggaatttgctga

SEQ ID NO: 517 - DNA, 1776 bp, Artificial Sequence
  Synthetic polynucleotide
taagtaggggaagagacaacacacacccaaaatggcaagaatccgctggcacggacaggctggacccaggacatgggtgtggaggcaaagaaccatgaagtacacaacagccacagatgaagcatattccatcggccccgctccctcccagcagagctacctatctatggagaaaatcattcaagtggccaagacctctgctgcacaggctatccatccaggatgcggttttctctcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactca

SEQ ID NO: 518 - DNA, 166 bp, Artificial Sequence; identical to SEQ ID NO: 516
  Synthetic polynucleotide

SEQ ID NO: 519 - DNA, 124 bp, Artificial Sequence; identical to SEQ ID NO: 515
  Synthetic polynucleotide

SEQ ID NO: 520 - DNA, 319 bp, Artificial Sequence
  Synthetic polynucleotide
taagtaggggaagagacaacacacacccaaaatggcaagaatccgctggcacggacaggctggacccaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatgcaggatgatcttgatttcacagagaaaataaaattgaggttcctgccacagaatctgctgacttag

SEQ ID NO: 521 - DNA, 372 bp, Artificial Sequence
  Synthetic polynucleotide
ataaaatacctaggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggcaaatactgtggtctggggttgcaaatgaaccattcaattgaatcaaaaggcaatgaaatcacattgctgttcatgagtggaatccatgtttctggacgcggatttttggcctcatactctgttatagataaacaaggtaattttcaccttttgcaatggttcctacagtttgtaatttctaacaacaaaaataaaatgctttttttaag

SEQ ID NO: 522 - DNA, 2056 bp, Artificial Sequence
  Synthetic polynucleotide
ataaaatacctaggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttga

SEQ ID NO: 523 - DNA, 2098 bp, Artificial Sequence
  Synthetic polynucleotide
ataaaatacctaggaatccaacttacaagggctgtgaaggacctcttcaaggagaactacaaaccactgctcaatgaaataaaagaggacacaaatggaagaacattccatgctcatggataggaagaatcaatatcgtgaaaatggctatactgcccaaggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggtttttatttaatggtctctttggcttgccgtcacaatgaaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttga

SEQ ID NO: 524 - DNA, 463 bp, Artificial Sequence
  Synthetic polynucleotide
ctgaggccaggaacctggtggcaagtactctctccctcaatggacacgaagtgtgaccttacacaagcaacaactccctttggatgtatttgccttattttttaaaatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 525 - DNA, 463 bp, Artificial Sequence; identical to SEQ ID NO: 524
  Synthetic polynucleotide

SEQ ID NO: 526 - DNA, 1211 bp, Artificial Sequence
  Synthetic polynucleotide
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 527 - DNA, 1133 bp, Artificial Sequence
  Synthetic polynucleotide
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 528 - DNA, 1211 bp, Artificial Sequence; identical to SEQ ID NO: 526
  Synthetic polynucleotide

SEQ ID NO: 529 - DNA, 841 bp, Artificial Sequence
  Synthetic polynucleotide
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 530 - DNA, 659 bp, Artificial Sequence
  Synthetic polynucleotide
aatgaaactacagggcactggagccttagaccctgccactttgttgacacctactgggcaaccaaaggaactagtacacaactgcctagtggttatagatcaagagtcttccaggcgaccagatctgaaggacacagccctccagggtggagactggatgctctttgtggacagaagcagcctagtcaccaacagaaggaggaatgctgtctaggctatagtgactctcttggaggtaatagctgcaagaactctcccaacagggacttctgtgcaaaaggctgagtaaattgcccttatgagagccttgcatctgtccaaaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 531 - DNA, 1636 bp, Artificial Sequence
  Synthetic polynucleotide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggaggtgaggggcgcctctgcccggccgcccctactgggaagtgaggagcccctctgcccggccagcaccccgtccgggagggaggtgggggggtcagccccccgcccggccagccgccccgtccgggagggaggtggggggggggtcagcccccccgcctggccagccgccccatccgggaggtgaggggcgcctctgcccggcggcccctactgggaagtgaggagcccctctgcccggccagccgccccgtccgggagggaggtggggggggtcagcccccccgcccggccagccgccccgtccgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 532 - DNA, 1328 bp, Artificial Sequence
  Synthetic polynucleotide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 533 - DNA, 334 bp, Artificial Sequence
  Synthetic polynucleotide
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggtaa

SEQ ID NO: 534 - DNA, 1516 bp, Artificial Sequence
  Synthetic polynucleotide
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaagaaaaatgtactacgcctgtgctgtaagaagctgaagatttttgcaatgcccatgcaggatatcaagatgatcctgaaaatggtgcagctggactctattgaagatttggaagtgacttgtacctggaagctacccaccttggcgaaattttctccttacctgggccagatgattaatctgcgtagactcctcctctcccacatccatgcatcttcctacatttccccggagaaggaagagcagtatatcgcccagttcacctctcagttcctcagtctgcagtgcctgcaggctctctatgtggactctttatttttccttagaggccgcctggatcagttgctcaggcacgtgatgaaccccttggaaaccctctcaataactaactgccggctttcggaaggggatgtgatgcatctgtcccagagtcccagcgtcagtcagctaagtgtcctgagtctaagtggggtcatgctgaccgatgtaagtcccgagcccctccaagctctgctggagagagcctctgccaccctccaggacctggtctttgatgagtgtgggatcacggatgatcagctccttgccctcctgccttccctgagccactgctcccagcttacaaccttaagcttctacgggaattccatctccatatctgccttgcagagtctcctgcagcacctcatcgggctgagcaatctgacccacgtgctgtatcctgtccccctggagagttatgaggacatccatggtaccctccacctggagaggcttgcctatctgcatgccaggctcagggagttgctgtgtgagttggggcggcccagcatggtctggcttagtgccaacccctgtcctcactgtggggacagaaccttctatgacccggagcccatcctgtgcccctgtttcatgcctaactag

SEQ ID NO: 535 - DNA, 1516 bp, Artificial Sequence; identical to SEQ ID NO: 534
  Synthetic polynucleotide

SEQ ID NO: 536 - DNA, 1516 bp, Artificial Sequence; identical to SEQ ID NO: 534
  Synthetic polynucleotide

SEQ ID NO: 537 - DNA, 1516 bp, Artificial Sequence; identical to SEQ ID NO: 534
  Synthetic polynucleotide

SEQ ID NO: 538 - DNA, 1516 bp, Artificial Sequence; identical to SEQ ID NO: 534
  Synthetic polynucleotide

SEQ ID NO: 539 - DNA, 591 bp, Artificial Sequence
  Synthetic polynucleotide
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagcacagaggcagagcagcccttcattccagtagaggtgctcgtagacctgttcctcaaggaaggtgcctgtgatgaattgttctcctacctcattgagaaagtgaagcgaaa

SEQ ID NO: 540 - DNA, 482 bp, Artificial Sequence
  Synthetic polynucleotide
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctcagcccatgacaaagaagcgaaaagtagatggtttgagca

SEQ ID NO: 541 - DNA, 444 bp, Artificial Sequence
  Synthetic polynucleotide
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctgatgaagggacaacatcttcacctggagaccttcaaagctgtgcttgatggacttgatgtgctccttgcccaggaggttcgccccaggaggtggaaacttcaagtgctggatttacggaagaactctcatcaggacttctggactgtatggtctggaaacagggccagtctgtactcatttccagagccagaagcagctca

SEQ ID NO: 542 - DNA, 245 bp, Artificial Sequence
  Synthetic polynucleotide
gaaaaacggttccattcagagccgatacatcagcatgagtgtgtggacaagcccacggagacttgtggagctggcagggcagagcctgctgaaggatgaggccctggccattgccgccctggagttgctgcccagggagctcttcccgccactcttcatggcagcctttgacgggagacacagccagaccctgaaggcaatggtgcaggcctggcccttcacctgcctccctctgggagtgctga

SEQ ID NO: 543 - DNA, 38 bp, Artificial Sequence
  Synthetic polynucleotide
gaaaaacggttccattcagagccgatacatcagcatga

SEQ ID NO: 544 - DNA, 387 bp, Artificial Sequence
  Synthetic polynucleotide
agagtcgggcagcagggtatctgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtaaagtggtcgaggagctgctgtcgggaaaccctcacatcgagaaggagtccgctcgctccatcgccgacggggccatga

SEQ ID NO: 545 - DNA, 540 bp, Artificial Sequence
  Synthetic polynucleotide
agagtcgggcagcagggtatctgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactga

SEQ ID NO: 546 - DNA, 540 bp, Artificial Sequence; identical to SEQ ID NO: 545
  Synthetic polynucleotide

SEQ ID NO: 547 - DNA, 303 bp, Artificial Sequence
  Synthetic polynucleotide
agagtcgggcagcagggtatctgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatcttgtggcttcctgggactagaagggggttgtgcggtggatgtgaaacaaggcccttga

SEQ ID NO: 548 - DNA, 367 bp, Artificial Sequence
  Synthetic polynucleotide
ctagaatgagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataa

SEQ ID NO: 549 - DNA, 367 bp, Artificial Sequence; identical to SEQ ID NO: 548
  Synthetic polynucleotide

SEQ ID NO: 550 - DNA, 1331 bp, Artificial Sequence
  Synthetic polynucleotide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 551 - DNA, 1028 bp, Artificial Sequence
  Synthetic polynucleotide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttga

SEQ ID NO: 552 - DNA, 1028 bp, Artificial Sequence; identical to SEQ ID NO: 551
  Synthetic polynucleotide

SEQ ID NO: 553 - DNA, 1295 bp, Artificial Sequence
  Synthetic polynucleotide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactga

SEQ ID NO: 554 - DNA, 1322 bp, Artificial Sequence
  Synthetic polynucleotide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactga

SEQ ID NO: 555 - DNA, 1013 bp, Artificial Sequence
  Synthetic polynucleotide
ccctccccctccccctctccctcttcctctccccacggtctccctctccctctctttccacggtctccctctaatgccgagccgaagctggactgtactgctgccatctcggctcactgcaacctccctgcctgattctcctgcctcagcctgcccagtgcctgcgactgcaggcgtgcgccgccacgcctgactggttttcgtatttttttggtggagacggggtttcactgtgttggcccggctggtctccagctcctaaccgcgaatgatccgccagcctcggcctcctgaggtgctgggattgcagacggagtctcgttcactcagtgctcaatggtgcccaggagtgatctcggctcgctacaacctccacctcccagccgcctgccttggcctcccaaagtgccgagattgcagcctctgcccggccgccaccccgtctgggaagtgaggagcgtttctgcctgggtgcccatcgtctgggatgtgaggagcccctctgcctggctgcccagtctggaaagtgaggagcgtctctgcccggccgccatcccatctaggaagtgaggagcgtctctgcccggccgcccatcgtctgagatgtggggagcgcctctgtcccgctgccccttctgggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaa

SEQ ID NO: 556 - DNA, 1013 bp, Artificial Sequence; identical to SEQ ID NO: 555
  Synthetic polynucleotide

SEQ ID NO: 557 - DNA, 7501 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 558 - DNA, 7492 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 559 - DNA, 373 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgccctgtgtgtccaaatgctgggagaacatcaccccttggatga

SEQ ID NO: 560 - DNA, 337 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttccctgtgtgtccaaatgctgggagaacatcaccccttggatga

SEQ ID NO: 561 - DNA, 301 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttcaactga

SEQ ID NO: 562 - DNA, 373 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgtgcagaagcagtgattgtgactgggtaatagacaagagaagtgagagaaactgctttctaggcaagatgctgttatga

SEQ ID NO: 563 - DNA, 442 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacggagcctgagtccaaccccatccagcccaggcagtccttgtagtcctctcttggcctttcacttttggagccctgtgtgtccaaatgctgggagaacatcaccccttggatga

SEQ ID NO: 564 - DNA, 373 bp, Artificial Sequence; identical to SEQ ID NO: 562
  Synthetic polynucleotide

SEQ ID NO: 565 - DNA, 1276 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaaggtgagtccctgggttgttcctacctttga

SEQ ID NO: 566 - DNA, 7528 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 567 - DNA, 418 bp, Artificial Sequence
  Synthetic polynucleotide
aactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggaggaatctgctatggatgggaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagggaatga

SEQ ID NO: 568 - DNA, 1775 bp, Artificial Sequence
  Synthetic polynucleotide
tgtccccagcctacccctttcctgaatcccaggctcatagccaactgcccacctatttccacgtggatgcctgctgagcacctcaaatgtcacacagccaagacagaactctggatctcctttcccagccacaagctgcccctcttccagtctgccactccccacctgtcctgcctttgtgtgcctctgtgtctttgctgggtggcctgacctttggttatgaactggcagtcatatcaggtgccctgctgccactgcagcttgactttgggctaagctgcttggagcaggagttcctggtgggcagcctgctcctgggggctctcctcgcctccctggttggtggcttcctcattgactgctatggcaggaagcaagccatcctcgggagcaacttggtgctgctggcaggcagcctgaccctgggcctggctggttccctggcctggctggtcctgggccgcgctgtggttggcttcgccatttccctctcctccatggcttgctgtatctacgtgtcagagctggtggggccacggcagcggggagtgctggtgtccctctatgaggcaggcatcaccgtgggcatcctgctctcctatgccctcaactatgcactggctggtaccccctggggatggaggcacatgttcggctgggccactgcacctgctgtcctgcaatccctcagcctcctcttcctccctgctggtacagatgagactgcaacacacaaggacctcatcccactccagggaggtgaggcccccaagctgggcccggggaggccacggtactcctttctggacctcttcagggcacgcgataacatgcgaggccggaccacagtgggcctggggctggtgctcttccagcaactaacagggcagcccaacgtgctgtgctatgcctccaccatcttcagctccgttggtttccatgggggatcctcagccgtgctggcctctgtggggcttggcgcagtgaaggtggcagctaccctgaccgccatggggctggtggaccgtgcaggccgcagggctctgttgctagctggctgtgccctcatggccctgtccgtcagtggcataggcctcgtcagctttgccgtgcccatggactcaggcccaagctgtctggctgtgcccaatgccaccgggcagacaggcctccctggagactctggcctgctgcaggactcctctctacctcccattccaaggaccaatgaggaccaaagggagccaatcttgtccactgctaagaaaaccaagccccatcccagatctggagacccctcagcccctcctcggctggccctgagctctgccctccctgggccccctctgcccgctcgggggcatgcactgctgcgctggaccgcactgctgtgcctgatggtctttgtcagtgccttctcctttgggtttgggccagtgacctggcttgtcctcagcgagatctaccctgtggagatacgaggaagagccttcgccttctgcaacagcttcaactgggcggccaacctcttcatcagcctctccttcctcgatctcattggcaccatcggcttgtcctggaccttcctgctctacggactgaccgctgtcctcggcctgggcttcatctatttatttgttcctgaaacaaaaggccagtcgttggcagagatagaccagcagttccagaagagacggttcaccctgagctttggccacaggcagaactccactggcatcccgtacagccgcatcgagatctctgcggcctcctga

SEQ ID NO: 569 - DNA, 898 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaagtgaggagcccctccgcccggcagccgccccctctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 570 - DNA, 961 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaagtgaggagcccctccgcccggcagccgccccctctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 571 - DNA, 898 bp, Artificial Sequence; identical to SEQ ID NO: 569
  Synthetic polynucleotide

SEQ ID NO: 572 - DNA, 818 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaagtgaggagcccctccgcccggcagccgccccctctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 573 - DNA, 427 bp, Artificial Sequence
  Synthetic polynucleotide
cccactgctgtttaaaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtga

SEQ ID NO: 574 - DNA, 7177 bp, Artificial Sequence
  Synthetic polynucleotide
tgatatggtttgtctgtgtccgcacagccaaatctcatcttgaattcccatgtgttgtgggaggcacctggtgggaggtaattgaatcatgggggcgggtctttcccatgctgttctcatgatagcgcataagtctcatgagatctgatggttttgaaaagggggagtttccctgcccaaactctctttttgcctgctgccatccgtgtaagatgtgacttggtcctccttgccttccgccatgattgtgaggtctccccagccacgtggaactggccagcagcttgaccttggcacaccacataatctgagtgaaccgtgtatccaaggatgtcacttttggaactctgtagatcagaaaaactgtgctttaaagtgtaatgatacttatgccaccgtttgtgagcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaa

SEQ ID NO: 575 - DNA, 7195 bp, Artificial Sequence
  Synthetic polynucleotide
tgatatggtttgtctgtgtccgcacagccaaatctcatcttgaattcccatgtgttgtgggaggcacctggtgggaggtaattgaatcatgggggcgggtctttcccatgctgttctcatgatagcgcataagtctcatgagatctgatggttttgaaaagggggagtttccctgcccaaactctctttttgcctgctgccatccgtgtaagatgtgacttggtcctccttgccttccgccatgattgtgaggtctccccagccacgtggaactggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaa

SEQ ID NO: 576 - DNA, 2471 bp, Artificial Sequence
  Synthetic polynucleotide
gccaggcgtggtggttcacgcctataatcccagcactttgggaggctgaggcaggtggatcacgaggtcaggagatcgacaccatcctggccaacatggtgaaaccccatctctactaaaatacaaaagattagccaggcgtggtggtgggcgcctgtaatcccacctactcaggaggctgaggcaggagaatcgcttgaatccaggaggcagagagtgcagtgagatgccaccgttctccagcctggcgacagaggcgacctcggggacgcggggccaaagccccccggctggcgtgcgagacagcgggcgtcatccgcatcagtgacgacagcagcacggagtcggaccctggcctggacagcgacttcaactcctcccccgagtccctggtggatgacgacgttgtcatcgttgatgcagtcgggctccccagtgacgaccggggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggagatgaccggcaggaaaggccgcgtggtgtccaggcccgacgggacggtggccttcgagtcgcgggcagagcagggtctgtccatcgaccacgtgaacctcagggagaagcagcgcttcatgagcggcgagaagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggccgcacccaccggtccaaccaggtctccgcgccagagtatgtcttcctcatctcggagctggccggggagcgccggttcgcctccatcgtggccaagcgcctggagagtctgggggccctgacccacggagaccgccgcgccacggagtcccgtgacctcagcaagtacaactttgagaacaagtatggcacccgggccctgcactgtgtcctcaccaccatcctgagccagactgagaacaaagtgcctgtgccccagggataccctggaggggtccccaccttcttccgggacatgaagcagggcctgctgtctgtgggcattggtggccgggagtcccggaatggctgcctggacgtggagaaggactgttccatcaccaagttcctgaaccgcatcctggggctggaggtgcacaagcagaacgccctgttccagtacttctcagacaccttcgaccacctcatcgagatggacaagcgggagggcaaatacgacatgggcatcctggaccttgctcccggtatcgaggagatctacgaggagagccagcaggtgttcctggctcccgggcacccgcaggacgggcaggtggtcttctacaagatcagcgtggaccgcggcctgaagtgggaggacgcctttgccaagtcgctggcgctgacgggcccctatgacggcttctacctctcctacaaggtccgcggtaacaagcccagctgcctgctggcggagcagaaccgcggccagttcttcacggtgtacaagcccaacatcggccggcagagccagctggaggccctggacagcctccgccgcaagttccaccgggtcaccgcggaggaggccaaggagccctgggagagtggctacgctttgtcgctgacgcactgcagccacagcgcctggaaccggcactgccggctggcgcaggagggtaaggactgcctgcaggggctgcggctgcggcaccactacatgctgtgcggcgcgctgctgcgcgtgtggggccgcatcgccgccgtcatggccgacgtcagcagcagcagctacctgcagatcgtgcggctgaagaccaaggacaggaagaagcaagtgggcatcaagatccccgagggctgcgtgcgccgggtgctgcaggagctgcggctgatggatgcggacgtgaagcgcaggcaggcgcccgccctgggctgccccgccccgcccgccccgcgcccgctggcgctgccttgcggccccggagaggtgctggacctcacctacagccccccggccgaggccttcccgccgcccccgcacttctctttcccggcgccgctgtccctggacgccggccccggcgtcgtgccgctgggcacccccgacgcccaggccgaccctgcggccctcgcgcaccagggctgcgacatcaacttcaaggaggtgctggaggacatgctgcgctcgctgcacgcggggccgccctccgagggcgcgctgggggagggcgcgggggcggggggcgcggcgggcggtggtcccgagcggcagagcgtgatccagttcagcccacccttccccggcgcccaggctcctctctga

SEQ ID NO: 577 - DNA, 2471 bp, Artificial Sequence; identical to SEQ ID NO: 576
  Synthetic polynucleotide

SEQ ID NO: 578 - DNA, 2471 bp, Artificial Sequence; identical to SEQ ID NO: 576
  Synthetic polynucleotide

SEQ ID NO: 579 - DNA, 1407 bp, Artificial Sequence
  Synthetic polynucleotide
aatgttatttctcatcaaacaaacttgacagtagttccaaatagccagaaaatggcactttgaatttttccatcctgcaagatctaaataattcttataataaaataggcaaatggtctgaggtgcctgacatccaggcattcttttacaaatcagtcccttcctagtctctgtgcccagtgcaactcgtcccaagtcttccttctttccctcccgcctgtcccctcagtaccatcccaagcgttgctgagtctttctaatcttccttttctacagacccatctaacctgtcccttcctccccaggctgctccttgccaggccgagctaggtcccaattcttcctcagcctccgctcctccaccctataatctttttatcgcctcccctcctcacgcctggtctaccttacagtttccttctgtgactggccctccccgacctgcccagcaatttactcttaaaaaggtggctggagctaaaggcatagtcaaagttaatgctcctttttctttatcccaaatcagatagcgtttaggctctttgtcatcaaatataaaaacccagcccagttcatgacttgtttggcagcaaccctgagacgctttacagccctagaacctaaaaggtcaaaaggccgtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacacctgaaccgcagccgccaggtgttcctccagaacctcctcccagaggagcttgctacacgtgccggaaatctggccactgggccaaggaatgcccgcagcctgggattcctcctaagcttcgtcccatctgtgtgggaccccactgaaaatcggactgttcaactcacctgacacccactcccagagcccctggaactctggcccaaggctctctgactgattccttcccagatcttctcggcttagtggctgaagactgacactgcccgatcacctcggaagccccctagaccatcacggacgccgagcttcgggtaactctcacagtggaagctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtga

SEQ ID NO: 580 - DNA, 1084 bp, Artificial Sequence
  Synthetic polynucleotide
ggcctccacatacagttgctcaggttgtatactgcacgagggcatccaaccaaggactcaagggacagtgatccccccacaggcctcgctggtctttcacgtcctcctgattgacgtgcacaacccgaaggacgctgtccagctagagacgctggagctcccccccggctgtgtccgcagagccggggccggggacttcatgcgctaccactacaatggctccttgatggacggcaccctcttcgattccagctactcccgcaaccacacctacaatacctatatcgggcagggttacatcatccccgggatggaccaggggctgcagggtgcctgcatgggggaacgccggagaattaccatccccccgcacctcgcctatggggagaatggaactggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 581 - DNA, 1815 bp, Artificial Sequence
  Synthetic polynucleotide
cacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagaccgggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtcggggatgtgaggagcccctctgcctggctgcccagtctggaaagtgaggagcgtctccacccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagtgcctctgcccggccgagaccccgtctgggaggtgaggagcgtctctgcccggccgccccgtctgagaagtgaggagaccctctgcctggcaaccaccccgtctgagaagtgaggagcccctctgcccggccagcaccccgtccgggagggaggtgggggggtcagccccccgcccggccagccgccccgtccgggagggaggtggggggggtcagcccccccgcccggccagccgccccgtccgggaggtgaggggcgcctctgcccggccgcccctactgggaagtgaggagcccctctgcccggccagcaccccgtccgggagggaggtgggggggtcagccccccgcccggccagccgccccgtccgggagggaggtggggggggggtcagcccccccgcctggccagccgccccatccgggaggtgaggggcgcctctgcccggcggcccctactgggaagtgaggagcccctctgcccggccagccgccccgtccgggagggaggtggggggggtcagcccccccgcccggccagccgccccgtccgggaggtgaggggcgcctctgcccggccgcccctactgggaagtgaggagcccctctgcccggccagccgccccgtccgggagggaggtgggggggtcagcccccccgctcggccagccgccccgtccgggagggaggtggggggggtcagcccccctgcccggccagccgccccgtccgggagattgatgatatatttaacgaaatcaaatttggtgaatatgtggacactggaaagctaatcgacaagatcaacttaccagatttcctaaaagtgtaccttaaccacaagccaccttttggtaacaccatgagtggcatccacaagagctttgaggtgctcggttataccaactccaaagggaaaaaggccattcgaagagaggacttcctgagactgctcgttactaaaggtgagcatatgacggaggaggagatgttggattgctttgcttcactgtttggcctgaatcccgagggatggaaatccgagcctgcaacctgctccgtcaaaggttcagaaatttgccttgaagaagaacttccagacgaaatcactgcagaaatattcgcgactgaaattcttggcttaaccatttcagaagattccggccaggatggtcagtga

SEQ ID NO: 582 - DNA, 858 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 583 - DNA, 921 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 584 - DNA, 858 bp, Artificial Sequence; identical to SEQ ID NO: 582
  Synthetic polynucleotide

SEQ ID NO: 585 - DNA, 778 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaagtgaggagaccctccgcccggcaaccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 586 - DNA, 2534 bp, Artificial Sequence
  Synthetic polynucleotide
gctgtaattaagaagtcaacaggaagtaaaaggaaaacataaaccttgtcaagagaaggcgaaaagaagaaaaaagaaaccaagaacagatcaaacaagtaggaaacagccagcaagatggtagattttaatccagccacatcagtgttcaggctgaacatgagtggttttgtttaaaagacaggcattgccatatgggacagaaacgcacagctcggccatacactgcaggaagtcctctttcagcacggaggcagaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctga

SEQ ID NO: 587 - DNA, 2534 bp, Artificial Sequence; identical to SEQ ID NO: 586
  Synthetic polynucleotide

SEQ ID NO: 588 - DNA, 463 bp, Artificial Sequence
  Synthetic polynucleotide
aatctggggctcatccaggattcccattctcctccagggaaggggtctctggtcacctctcataaggagacgcatcccactgcctcgttgcggtggcctcagggtgagggatcggaacccacccggtgtgacgaataaatccggactctcagcaatgtggggaaaaaaaggcttgcaacaccatggtgaccaggtaactttgtgcacagaccaagtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatga

SEQ ID NO: 589 - DNA, 463 bp, Artificial Sequence; identical to SEQ ID NO: 588
  Synthetic polynucleotide

SEQ ID NO: 590 - DNA, 1022 bp, Artificial Sequence
  Synthetic polynucleotide
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 591 - DNA, 347 bp, Artificial Sequence
  Synthetic polynucleotide
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatgatggaagggggagagctgtttga

SEQ ID NO: 592 - DNA, 1109 bp, Artificial Sequence
  Synthetic polynucleotide
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggcagacccagctctcaatgttgaaacagaaatagaaattttgaaaaagctaaatcatccttgcatcatcaagattaaaaacttttttgatgcagaagattattatattgttttggaattgatggaagggggagagctgtttgacaaagtggtggggaataaacgcctgaaagaagctacctgcaagctctatttttaccagatgctcttggctgtgcagtaccttcatgaaaacggtattatacaccgtgacttaaagccagagaatgttttactgtcatctcaagaagaggactgtcttataaagattactgattttgggcactccaagattttgggagagacctctctcatgagaaccttatgtggaacccccacctacttggcgcctgaagttcttgtttctgttgggactgctgggtataaccgtgctgtggactgctggagtttaggagttattctttttatctgccttagtgggtatccacctttctctgagcataggactcaagtgtcactgaaggatcagatcaccagtggaaaatacaacttcattcctgaagtctgggcagaagtctcagagaaagctctggaccttgtcaagaagttgttggtagtggatccaaaggcacgttttacgacagaagaagccttaagacacccgtggcttcaggatgaagacatgaagagaaagtttcaagatcttctgtctgaggaaaatgaatccacagctctaccccaggttctagcccagccttctactagtcgaaagcggccccgtgaaggggaagccgagggtgccgagaccacaaagcgcccagctgtgtgtgctgctgtgttgtga

SEQ ID NO: 593 - DNA, 1109 bp, Artificial Sequence; identical to SEQ ID NO: 592
  Synthetic polynucleotide

SEQ ID NO: 594 - DNA, 1109 bp, Artificial Sequence; identical to SEQ ID NO: 592
  Synthetic polynucleotide

SEQ ID NO: 595 - DNA, 1109 bp, Artificial Sequence; identical to SEQ ID NO: 592
  Synthetic polynucleotide

SEQ ID NO: 596 - DNA, 1109 bp, Artificial Sequence; identical to SEQ ID NO: 592
  Synthetic polynucleotide

SEQ ID NO: 597 - DNA, 347 bp, Artificial Sequence; identical to SEQ ID NO: 591
  Synthetic polynucleotide

SEQ ID NO: 598 - DNA, 1022 bp, Artificial Sequence; identical to SEQ ID NO: 590
  Synthetic polynucleotide

SEQ ID NO: 599 - DNA, 1109 bp, Artificial Sequence; identical to SEQ ID NO: 592
  Synthetic polynucleotide

SEQ ID NO: 600 - DNA, 269 bp, Artificial Sequence
  Synthetic polynucleotide
ggcggggcgcggtggctcacgtctttaatcccagcactttgggaggccgaggctggcagatcacctgagtttttgtcttttttgatctgactgtagatgatcagtcagtttatcctaaggcattaagagatgaatacatcatgtcaaaaactcttggaagtggtgcctgtggagaggtaaagctggctttcgagaggaaaacatgtaagaaagtagccataaagatcatcagcaaaaggaagtttgctattggttcagcaagagaggca

SEQ ID NO: 601 - DNA, 85 bp, Artificial Sequence
  Synthetic polynucleotide
ggcggggcgcggtggctcacgtctttaatcccagcactttgggaggccgaggctggcagatcacctgagtttttgtcttttttga

SEQ ID NO: 602 - DNA, 414 bp, Artificial Sequence
  Synthetic polynucleotide
tgatatggcttggctctttgtcctcacctaaatctcatctctaattgtaatccccacgtgttgagggagggacctggtaggaggtgattagatcatgggggcggtttccctcatgctgttctcatgatagtgactgagttctcacgagatctgatggtttaaaagtgtttggcagttcacctcattgctcgctgtcttgcctccacgtgaagaaggtccttacttcccctttgccttctgccacaattgtaagtttcctgaggcctctccagccaagcagaactggaacaatggcaaaagcctttgatgaagcattttcctctgagacaacagcggcaatacctgaagaccatgaagcatctgctgagtccttttgttccatcttctttcttcctgatcttgatcgccccctga

SEQ ID NO: 603 - DNA, 434 bp, Artificial Sequence
  Synthetic polynucleotide
tgatatggcttggctctttgtcctcacctaaatctcatctctaattgtaatccccacgtgttgagggagggacctggtaggaggtgattagatcatgggggcggtttccctcatgctgttctcatgatagtgactgagttctcacgagatctgatggtttaaaagtgtttggcagttcacctcattgctcgctgtcttgcctccacgtgaagaaggtccttacttcccctttgccttctgccacaattgtaagtttcctgaggcctctccagccaagcagaactggaacaatggcaaaagcctttgatgaagcattttcctctgagacaacagcggcaatacctgaagaccatgaagcatctgctgagtccttttgttccatcttctttcttcctgatcttgatcgccccctgatgcatcttcatcctgaataa

SEQ ID NO: 604 - DNA, 861 bp, Artificial Sequence
  Synthetic polynucleotide
gagcgggaaccggactgggagccggagccggggcgggaaccggagctggagccgaagctggagccggcactgcggcgcacggagcggagcgctgcagccaagccgatagcacgatacaaccgcaccagctacttctaccccacattctcagagagctcggagcacagccatctgctcgtgtcccccgtgctggtggcgagtgccgtcataggtgtggtcatcatcctctcctgcatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggatgcgctatgcctgcagctcctcagaggactggcccccacccttggacatcagctctgacggggacgtggatgccacggtgctcagggagctgtacccagattctccaccaggctacgaggagtgtgtggggccaggggccactcagctgtatgtccccacggacgcaccaccaccctactcgctgactgattcctgccccacgctggatggcacctccgactcaggcagcggccacagccctggccgacaccagcaggagcagaggaccccggcccaaggtggccttcacacggtctccatggacacccttcccccctacgaggctgtgtgcggggctggccccccatcaggcctgctgccactgccgggcccagacccagggccaaggggctcccagggctcacccaccccaacccgggccccagcctctggcccagagaggattgtgtga

SEQ ID NO: 605 - DNA, 56 bp, Artificial Sequence
  Synthetic polynucleotide
ccccagaaagggtcttgaacttggtttcctgccctggacttaacctgccttcctga

SEQ ID NO: 606 - DNA, 763 bp, Artificial Sequence
  Synthetic polynucleotide
gagcctcagtgtcctcacctgtcaagtgggcaagccatgctgatccgcagggtaagttactgggagtttgcaagacggagacaagatccctggctctgccgtgctaatcttcaacgtccatgtcattgacttccacaaccctgcggatgtggtggaaatcaggacactgtcccggccatctgagacctgcaatgagaccaccaagcttggggactttgttcgataccattacaactgttctttgctggacggcacccagctgttcacctcgcatgactacggggccccccaggaggcgactctcggggccaacaaggtgatcgaaggcctggacacgggcctgcagggcatgtgtgtgggagagaggcggcagctcatcgtgcccccgcacctggcccacggggagagtggagcccggggagtcccaggcagtgctgtgctgctgtttgaggtggagctggtgtcccgggaggatgggctgcccacaggctacctgtttgtgtggcacaaggaccctcctgccaacctgtttgaagacatggacctcaacaaggatggcgaggtccctccggaggagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctga

SEQ ID NO: 607 - DNA, 763 bp, Artificial Sequence; identical to SEQ ID NO: 606
  Synthetic polynucleotide

SEQ ID NO: 608 - DNA, 763 bp, Artificial Sequence; identical to SEQ ID NO: 606
  Synthetic polynucleotide

SEQ ID NO: 609 - DNA, 501 bp, Artificial Sequence
  Synthetic polynucleotide
gactgggcgcaggggctgatgcctgtcatcccagcactttgggtggcactggtgggcagatcacttaaggccaggagttcgagaccagtctggaacacagtgaaatcctgtctctactaaaaatacaaaaattagccaggcgtgatggcacatgtctgtaatcccagctactggggaggctgaagcacgagaatcgcttgagcctgggagatagaggttgcggagatctattgggaaactgattataaccactcgggcaccatcgatgcccacgagatgaggacagccctcaggaaggcaggtttcaccctcaacagccaggtgcagcagaccattgccctgcggtatgcgtgcagcaagctcggcatcaactttgacagcttcgtggcttgtatgatccgcctggagaccctcttcaaactattcagccttctggacgaagacaaggatggcatggttcagctctctctggccgagtggctgtgctgcgtgttggtctga

SEQ ID NO: 610 - DNA, 501 bp, Artificial Sequence; identical to SEQ ID NO: 609
  Synthetic polynucleotide

SEQ ID NO: 611 - DNA, 1023 bp, Artificial Sequence
  Synthetic polynucleotide
ggaggagccaagatggccgaataggaacagctccggtctacagctcccagcgtgagcgacgcagaagacgggtgatttctgcatttccatctgaggttaacaattcatgctgagtgtcccatgcatttggaagattttcccatggatgtgcatgcctgcccactgaagtttggaagctatgcctatacaacagctgaagtggtttattcttggactctcggaaagaacaaatccgtggaagtggcacaggatggttctcgcttgaaccagtatgaccttttgggccatgttgttgggacagagataatccggtctagtacaggagaatatgtcgtcatgacaacccacttccatctcaagcgaaaaattggctactttgtgatccagacctacttgccatgtatcatgactgtcattctgtcacaagtgtcgttctggctcaacagagagtctgttcctgcccgtacagtctttggtgtcaccactgtgcttaccatgaccaccttgagtatcagtgccagaaattccttacctaaagtggcatatgcgacggccatggactggttcatagccgtctgttatgcctttgtattttctgcactgattgaatttgccactgtcaactatttcaccaagcggagttgggcttgggaaggcaagaaggtgccagaggccctggagatgaagaagaaaacaccagcagccccagcaaagaaaaccagcactaccttcaacatcgtggggaccacctatcccatcaacctggccaaggacactgaattttccaccatctccaagggcgctgctcccagtgcctcctcaaccccaacaatcattgcttcacccaaggccacctacgtgcaggacagcccgactgagaccaagacctacaacagtgtcagcaaggttgacaaaatttcccgcatcatctttcctgtgctctttgccatattcaatctggtctattgggccacatatgtcaaccgggagtcagctatcaagggcatgatccgcaaacagtag

SEQ ID NO: 612 - DNA, 1023 bp, Artificial Sequence; identical to SEQ ID NO: 611
  Synthetic polynucleotide

SEQ ID NO: 613 - DNA, 895 bp, Artificial Sequence
  Synthetic polynucleotide
aagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtga

SEQ ID NO: 614 - DNA, 247 bp, Artificial Sequence
  Synthetic polynucleotide
aagatgaaaaggttctggagatggatggcagtgatggttgcacaagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatga

SEQ ID NO: 615 - DNA, 551 bp, Artificial Sequence
  Synthetic polynucleotide
aagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggcc

SEQ ID NO: 616 - DNA, 1269 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 617 - DNA, 1134 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 618 - DNA, 501 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcaactctga

SEQ ID NO: 619 - DNA, 1321 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagatctcttggaaagtctcacaggcccgcttcattatggcatctgggcccaggacaactggagcagctccacgtggcgggagcggagcacctggccgggcctcgcctcaacccagggaaccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagcc

SEQ ID NO: 620 - DNA, 1197 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctccctggccagcaagaaacctaaaagggaaacaaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 621 - DNA, 1203 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccaggacggcccacctccatggagacggcccacggcctcgccaccaccagccccacctggcctccacttggtggccccagccccgatcccagcgccgccgagctgaccccactctga

SEQ ID NO: 622 - DNA, 1131 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactctaactctgacagcgtcccacctggctacgagcccatctcgctgctcgaggcgctcaacggcctccgggctgtctccccggccatcccctcggcccctctttatgaagaaatcacctattcaggcatctcggacggcctgtcccaggccagctgtcccctcgcggctatcgaccacatcctggacagcagccgccagaagggcaggccgcagagcaaggcccccgacagcaccctacggtccccgtcttcccccatccacgaagaggatgaggagaagctctccgaggacgtggacgcccctcccccactgggtggcgcagagctggccctgcgggaaagcagctcccctgagagtttcataacagaagaggttgatgagtcgtcgtcaccacagcaagggacccgagcagcttccattgagaatgtcctgcaggacagcagccccgagcactgtggccgaggcccacctgctgacatctacctgccagccctggggcccgactcctgctctgttggtatagacgagtaa

SEQ ID NO: 623 - DNA, 642 bp, Artificial Sequence
  Synthetic polynucleotide
ggccgggcgcggtggctcatgcctgtaatcccagcactttgggaggccgaggcaggcggatcacgaggtcaggagatcaagaccatcctggctaacacgctgaactttgacctggaccggggcgtgtttccagtagtcatccaggctgtggtggacgaaggagatgcagtggtggaagtgactggccacgcccacgtgctcttggctgcctttgaaaagcacatggacggcagcttctctgtgaagcctttaaagcagaagcaaattgtggaccgggtcagctacctcctgcaggagatctatggcattgagaacaagaacaaccaggagaccaagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcctttccgggccctcctgcagatccgggcggtgcggaagaagccaggagccctgtcccccgtgtccttcagccccgtcctggcccagagcctggagcatgatgagcactcttgtccctttaaaaaatcaaagccgcaccccgcctcc

SEQ ID NO: 624 - DNA, 829 bp, Artificial Sequence
  Synthetic polynucleotide
gccaggcgtggtggctcacggctgtaatcccagactttcggaggcggaggcaggcagatacgaggccaggagattgagaccatcctggctaacttgcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtag

SEQ ID NO: 625 - DNA, 1257 bp, Artificial Sequence
  Synthetic polynucleotide
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctga

SEQ ID NO: 626 - DNA, 1215 bp, Artificial Sequence
  Synthetic polynucleotide
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctga

SEQ ID NO: 627 - DNA, 1257 bp, Artificial Sequence; identical to SEQ ID NO: 625
  Synthetic polynucleotide

SEQ ID NO: 628 - DNA, 507 bp, Artificial Sequence
  Synthetic polynucleotide
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggat

SEQ ID NO: 629 - DNA, 313 bp, Artificial Sequence
  Synthetic polynucleotide
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgg

SEQ ID NO: 630 - DNA, 291 bp, Artificial Sequence
  Synthetic polynucleotide
ggccgggcacggtggctcacgactgtaatcccagcactttgggaggccgaggcgggcagatcacaaggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccatt

SEQ ID NO: 631 - DNA, 1046 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 632 - DNA, 968 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 633 - DNA, 1046 bp, Artificial Sequence; identical to SEQ ID NO: 631
  Synthetic polynucleotide

SEQ ID NO: 634 - DNA, 676 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 635 - DNA, 494 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 636 - DNA, 920 bp, Artificial Sequence
  Synthetic polynucleotide
gagccaagatggccgaataggaacagctccggtctacagctcccagcgtgagcgatgcagaagatgggtgatttctgcatttccatctgaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctga

SEQ ID NO: 637 - DNA, 920 bp, Artificial Sequence; identical to SEQ ID NO: 636
  Synthetic polynucleotide

SEQ ID NO: 638 - DNA, 641 bp, Artificial Sequence
  Synthetic polynucleotide
agccaagatggccgaacaggaacagctccggtctacacctcccagcgtgagtgacacagaagacgggtgatttctgcatttccatctgagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctga

SEQ ID NO: 639 - DNA, 2066 bp, Artificial Sequence
  Synthetic polynucleotide
atgaagcctccataaaatcccagaaggacagggttcagtgagcttccacatagctgaacacttggactttcatggaggttggcacagccagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaa

SEQ ID NO: 640 - DNA, 2066 bp, Artificial Sequence; identical to SEQ ID NO: 639
  Synthetic polynucleotide

SEQ ID NO: 641 - DNA, 2066 bp, Artificial Sequence; identical to SEQ ID NO: 639
  Synthetic polynucleotide

SEQ ID NO: 642 - DNA, 2066 bp, Artificial Sequence; identical to SEQ ID NO: 639
  Synthetic polynucleotide

SEQ ID NO: 643 - DNA, 2066 bp, Artificial Sequence; identical to SEQ ID NO: 639
  Synthetic polynucleotide

SEQ ID NO: 644 - DNA, 2066 bp, Artificial Sequence; identical to SEQ ID NO: 639
  Synthetic polynucleotide

SEQ ID NO: 645 - DNA, 2066 bp, Artificial Sequence; identical to SEQ ID NO: 639
  Synthetic polynucleotide

SEQ ID NO: 646 - DNA, 476 bp, Artificial Sequence
  Synthetic polynucleotide
atgaagcctccataaaatcccagaaggacagggttcagtgagcttccacatagctgaacacttggactttcatggaggttggcacagccagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagggctctataatgggatcattgcatttctctga

SEQ ID NO: 647 - DNA, 488 bp, Artificial Sequence
  Synthetic polynucleotide
atgaagcctccataaaatcccagaaggacagggttcagtgagcttccacatagctgaacacttggactttcatggaggttggcacagccagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacaggatcctggatggaattgaacccatatacgttacttgacatgtga

SEQ ID NO: 648 - DNA, 1284 bp, Artificial Sequence
  Synthetic polynucleotide
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccggagctgcaactggaggagagctgtgcggaggcgcaggacggggagctggacgggctgtggacgaccatcaccatcttcatcacactcttcctgttaagcgtgtgctacagtgccaccgtcaccttcttcaaggtgaagtggatcttctcctcggtggtggacctgaagcagaccatcatccccgactacaggaacatgatcggacagggggcctag

SEQ ID NO: 649 - DNA, 1077 bp, Artificial Sequence
  Synthetic polynucleotide
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatga

SEQ ID NO: 650 - DNA, 972 bp, Artificial Sequence
  Synthetic polynucleotide
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatga

SEQ ID NO: 651 - DNA, 743 bp, Artificial Sequence
  Synthetic polynucleotide
gtattatatattgagttgagaaagtcaagggctttggagtcagacttcttgggtctaaactctacctctgccacttctgaactgtcaccttgggtaagtcacctgacttgtctgcacctcagtttccttatctcttacatgaagataataagaagccctacctcctaggatcactgtaaggatgacatgggaggagccatgtgaagcactcagcacagtccttggaacaagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctga

SEQ ID NO: 652 - DNA, 743 bp, Artificial Sequence; identical to SEQ ID NO: 651
  Synthetic polynucleotide

SEQ ID NO: 653 - DNA, 539 bp, Artificial Sequence
  Synthetic polynucleotide
gtattatatattgagttgagaaagtcaagggctttggagtcagacttcttgggtctaaactctacctctgccacttctgaactgtcaccttgggtaagtcacctgacttgtctgcacctcagtttccttatctcttacatgaagataataagaagccctacctcctaggatcactgtaaggatgacatgggaggagccatgtgaagcactcagcacagtccttggaacaagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggtgggtttctgaatcctgaggctcctgttggccatgtgaaaggaaaatga

SEQ ID NO: 654 - DNA, 1218 bp, Artificial Sequence
  Synthetic polynucleotide
tgaagagtagcagaatatgccactttcaaacaagaataattttgagccgaagacaattaaaaagaagcatacccaagaaaaaaatccctgcccactccctttctaccaggaaaagcagaggattcttagtccttggagacaactctagatgcttatcagcccagagaaggcactagaggaatctacacaacaaactagcaagctatcttctgttagcttcccctatatatttacttcccagaatttgctgccctacagtcctcaggactctactccctcagcagcgtggtgaccgtgccctccagcagcttgggcacccagacctacacctgcaacgtgaatcacaagcccagcaacaccaaggtggacaagagagttgagctcaaaaccccacttggtgacacaactcacacatgcccacggtgcccagagcccaaatcttgtgacacacctcccccgtgcccacggtgcccagagcccaaatcttgtgacacacctcccccatgcccacggtgcccagagcccaaatcttgtgacacacctcccccgtgcccaaggtgcccagcacctgaactcctgggaggaccgtcagtcttcctcttccccccaaaacccaaggatacccttatgatttcccggacccctgaggtcacgtgcgtggtggtggacgtgagccacgaagaccccgaggtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggacagccccgagaaccacaggtgtacaccctgcccccatcccgggaggagatgaccaagaaccaggtcagcctgacctgcctggtcaaaggcttctaccccagcgacatcgccgtggagtgggagagcagcgggcagccggagaacaactacaacaccacgcctcccatgctggactccgacggctccttcttcctctacagcaagctcaccgtggacaagagcaggtggcagcaggggaacatcttctcatgctccgtgatgcatgaggctctgcacaaccgcttcacgcagaagagcctctccctgtctccgggtaaatga

SEQ ID NO: 655 - DNA, 5350 bp, Artificial Sequence
  Synthetic polynucleotide
acacccagcacccagatcttggtttctaataccattctccaataaagggaaccaggggagtctttggagaaatggctgattctaggattggggcagggggtatagcagatgagcccagagcatctggtagtgccagaaagaaaggaaaggctaaaaaaaaaatccctcattgatggggatatggcaaagggacacatgagtcaacgaaaagagctcccaatggctaaagctggaagaacttgagcaacaaaataaagtagcattggatttaatgcaaagtataaaataaatatccatgagtccatactgatataaataaatggttgaattaataatagatggagacgagataaagctcccatttagaagaattccaaataatttatgtagatactccaccctcaaggaggtggagcataactctctactccttaagtgttggctacgcatagttacttccttccaaagagtaaagtgtggaaagtaggggagaaagagtatctttacagtgaagaaatctgacgaacactatttcagccaggagatcaaggtcaaacccattagtgtacatcatgttggtagtatgtacccttgatataatttgatcagaatggcactttattacctctgtgctcttcctcccaaaagcctatcacccctgtctaactgtaagaaaaaacaatcagacacatttcagtcaagggtattctgcaaaatacctgaccagtactcctcaaaactgttaaggtcatcaaaaacaagaaaagtctgagaaactgtcacagcacagaagagcctaagaagacatgacgactaaatataatttgttatcgtggatgggatcctggaacagaaagagaacattagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaa

SEQ ID NO: 656 - DNA, 5350 bp, Artificial Sequence; identical to SEQ ID NO: 655
  Synthetic polynucleotide

SEQ ID NO: 657 - DNA, 1397 bp, Artificial Sequence
  Synthetic polynucleotide
acctggaaagtcatccttgtgtcttcccctttatttcaccattcatgtcctgtctatcaacagtccttccaccagtatctctaaaatatctcctgaatcagcccacttccttccatcttcactacatgcaccctggccttccaagctactatcggctctcaaccagactgctgggaccacctgatctctctgcttccactctgtctcaacccccatctattttccaagcagcactagagttatcatattaaaatgtaaatatcagttttttttttaaagaaaaaaaccctgagacttaacagagttataaaaaatataaatgtcatcatcagttccctgcttaaaacccttaactcgcttccaattgcacttggaatgaaaccaaactgcactgatccagcccttgcctgcctccccaaagtccaaggggtcatggctctttccctggctacactggttttctttctgtccctcaacactgcaagcctattgctgccccagggcctttacacttgctttttttctgcctagaacagttcttccccaaagatttttaaagggccgggctccttaacattgaagtcgcagaccaaacgccacatatgcagacagttcttctctaactactttaaaatagccctctgtccattcattcttcatcacattaacctgtttaattttcttctcagagctccacactatttggaagtatttgttgacttgttaccatgtctccccactagagtcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaa

SEQ ID NO: 658 - DNA, 701 bp, Artificial Sequence
  Synthetic polynucleotide
tggataggcagccctttgacctcacccctccacttcagccagagcagcttccttttagctgtttgattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagagcctgtag

SEQ ID NO: 659 - DNA, 701 bp, Artificial Sequence; identical to SEQ ID NO: 658
  Synthetic polynucleotide

SEQ ID NO: 660 - DNA, 701 bp, Artificial Sequence; identical to SEQ ID NO: 658
  Synthetic polynucleotide

SEQ ID NO: 661 - DNA, 701 bp, Artificial Sequence; identical to SEQ ID NO: 658
  Synthetic polynucleotide

SEQ ID NO: 662 - DNA, 861 bp, Artificial Sequence
  Synthetic polynucleotide
gacatctccagtatgtctacacttgttttcatccaactgtcaacttgacacctatacttaagatgtttgatgggcatctcactattaacttggccaacacagaagtttctaatttcctacatcaccaacttaatcttcacaatgtttctgtagatcagtgaagggaacttgccttcctccaagttgcttaatagtgacaaaaaaatttaggagaaaattcttcatcctcagcacgttatcctgactctatccgcaacctgtatctgggatctattcaccattctcaccattctccattctttctgaaaatttctaagtttaaaccaccatattctcattagactctcaagagtttccagtggtgtctgcctgtttcctgttaggtctcctttaaagccattatttaacagcagataatcgaaaagtatagatcatgtaatgttctactcctgtttaaaactctgtggtgacttcccattacagttagaataaggttcagacttcttaaaatggtccacaaatgtttctctgacctgtcctttgccttgttgcagacaactgtggcccctctcccgcctccttcaccgccccacagctctgctggccttcttttctaccttgaacatgccaagctctgttaccatctatgatttttttcatattctacaacatctaccgtcttcatatttgcctttatctctgtctaggatgccccttctagatgttcatggctcactccctgccatgttgtcaggtatttgagctctctgttcccactcagagtagatgagcagaagaggaaatgagggccttcccagagcaactcccccagaaaattcacaagaagagaggaaatactga

SEQ ID NO: 663 - DNA, 861 bp, Artificial Sequence; identical to SEQ ID NO: 662
  Synthetic polynucleotide

SEQ ID NO: 664 - DNA, 2429 bp, Artificial Sequence
  Synthetic polynucleotide
ttgcctgatctgcatacatgtcaccaccttacagaatgacaaagtcagaaagagggaaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatga

SEQ ID NO: 665 - DNA, 365 bp, Artificial Sequence
  Synthetic polynucleotide
ttgcctgatctgcatacatgtcaccaccttacagaatgacaaagtcagaaagagggaaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactc

SEQ ID NO: 666 - DNA, 136 bp, Artificial Sequence
  Synthetic polynucleotide
ttggtcgctgtggcacccactgaataaaaggagactcagtggcagtggatctgggacagatttcactctcaccatcagctgcctgcagtctgaagattttgcaacttattactgtcaacagtattatagttaccct

SEQ ID NO: 667 - DNA, 1014 bp, Artificial Sequence
  Synthetic polynucleotide
tgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgacctcgagggcctccaccagcaggactcctgcactga

SEQ ID NO: 668 - DNA, 1158 bp, Artificial Sequence
  Synthetic polynucleotide
tgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggtaatatttcagccatgatccagtcaggggagagggcacaggcataa

SEQ ID NO: 669 - DNA, 1125 bp, Artificial Sequence
  Synthetic polynucleotide
tgtggggaaaagcaagagggatcagattgttactgtgtctgtgtagaaagaagtagacataggagactccattttgttctgcactaagaaaaattcttctgccttgagatgctgttaatctatgaccttacccccaacaccgtgctctctgaaacatgtgctgtgtcgaactcagggttaaatggattaagggttgtgcaagatgtgctttgttaaacagatgcttgaaggcagcatgctccttaagagtcatcaccactccctaatctcaagtacccagggacacaaacactgcggaaggctgcagggacctctgcctaggaaagccagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctgcgcacgaccttgcagcggcaagtggagcccacagtgaccatctccccatccaggacagaggccctcaaccaccacaacctgctggtctgctcggtgacagatttctatccagcccagatcaaagtccggtggtttcggaatgaccaggaggagacagccggtgttgtgtccacctccctcattaggaatggtgactggaccttccagattctggtgatgctggaaataactccccagcgtggagacatctacacctgccaagtggagcaccccagcctccagagccccatcaccgtggagtggcgggctcagtctgaatctgcccagagcaagatgctgagtggcattggaggcttcgtgctggggctgatcttcctcgggctgggccttatcatccgtcacaggggtcagaaaggacctcgagggcctccaccagcaggactcctgcactga

SEQ ID NO: 670 - DNA, 1694 bp, Artificial Sequence
  Synthetic polynucleotide
tgtggaggaaaagctaaatatcaaatttgaactcaactgaacatggacacaaacaatggtcaccaagtcctggaacaggttgtgtaagccccttgaggcattcatccaacactgtttcagagaaatctctactttgatctattcctatatattagttattgaaaaataacagacgattacaaaaacaagttgacctttttgtgttccttgagcccagtgtgaagggccctcttgactgggcctcatgccaaacaacttgttacaaaaagagctagggtcccagactacgtcaaagcttcatgagacctctcctcatctgtgcacggacaagtggctgactctggagcccaggctgttgcttcctggcctggtggtgaatcctccatagtctggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagtaatcaaagcaaagaagctttcattgactgggcaagatatgatgattcacgggatcacttttgtgaacttgatgatgagagatctccagctgctcagtatgtagacctattgctgaacccagagcgttacactggctataaagggacctctgcatggagagtgtggaacagcatctatgaagagaactgtttcaagcctcgatctgtttatcgtcctttaaatcctctggcgcctagccgaggcgaagatgatggagaatcattctacacatggctagaaggtttgtgtctggagaaaagagtcttctataagcttatatcgggacttcatgctagcatcaatttacatctatgcgcaaattatcttttggaagaaacctggggtaagcccagttggggacctaatattaaagaattcaaacaccgctttgaccctgtggaaaccaagggagaaggtccaagaaggctcaagaatctttactttttatacttgattgagcttcgagctttgtcaaaggtggctccatattttgagcgctcaattgtcgatctttacactggaaatgcagaagaagatgctgacacaaaaactcttctactgaatatctttcaagatacaaagtcctttcccatgcactttgatgagaaatccatgtttgcaggtgacaaaaaaggggccaagtcactaaaggaggaattccgattacatttcaagaatatctcccgtataatggactgtgttggatgtgacaaatgcagattatggggaaaattacagactcagggtttaggaactgccctgaagatattattctctgaaaaagaaatccaaaagcttccagagaatagtccatctaaaggcttccaactcacccgacaggaaatagttgctcttttaaatgcttttggaaggctttctacaagtataagagacttacagaattttaaagtcttattacaacacagtaggtaa

SEQ ID NO: 671 - DNA, 725 bp, Artificial Sequence
  Synthetic polynucleotide
tgtggaggaaaagctaaatatcaaatttgaactcaactgaacatggacacaaacaatggtcaccaagtcctggaacaggttgtgtaagccccttgaggcattcatccaacactgtttcagagaaatctctactttgatctattcctatatattagttattgaaaaataacagacgattacaaaaacaagttgacctttttgtgttccttgagcccagtgtgaagggccctcttgactgggcctcatgccaaacaacttgttacaaaaagagctagggtcccagactacgtcaaagcttcatgagacctctcctcatctgtgcacggacaagtggctgactctggagcccaggctgttgcttcctggcctggtggtgaatcctccatagtctggtcactggagttctggatgattgcttgtgtgatattgacagcatcgataacttcaatacctacaaaatcttccccaaaataaaaaaattgcaagagagagactattttcgttattacaaggttaatctgaagcgaccttgtcctttctgggcagaagatggccactgttcaataaaagactgtcatgtggagccctgtccagagagtaaaattccggttggaataaaagctgggcattctaataagtacttgaaaatggcaaacaataccaaagaattagaagattgtgagcaagctaataaactgggagcaattaacagcacattaagatga

SEQ ID NO: 672 - DNA, 611 bp, Artificial Sequence
  Synthetic polynucleotide
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtatgatcttagctttgataaatgactga

SEQ ID NO: 673 - DNA, 464 bp, Artificial Sequence
  Synthetic polynucleotide
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgtggtagcaactgcccttgctaa

SEQ ID NO: 674 - DNA, 470 bp, Artificial Sequence
  Synthetic polynucleotide
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgtatgatcttagctttgataaatgactga

SEQ ID NO: 675 - DNA, 605 bp, Artificial Sequence
  Synthetic polynucleotide
tgtggggaaaagcaagagagatcagattgttactgtgtctgtgtagaaagaagtagacataggagactccattttgttatgtactaagaaaaatccttctgccttgagattctgttaatctataaccttacccccaaccccgtgctctctgaaacatgtgctgtgtcaactcagagttgaatggattaacggcggtgcaagatgtgctttgttaaacagatgcttgaaggcagcatgctccttaagagtcatcaccactccctaatctcaagtacccagggacacaaaaactgcggaaggccgcagggacctctgcctaggaaagccagtgggtaattccagaattgattggccataccattgtcactgtattactgctcatgtcattgcactggttcatcttccttctcaacttacctgttgccacttggaatatatatcgatacattatggtgccgagtggtaacatgggagtgtttgatccaacagaaatacacaatcgagggcagctgaagtcacacatgaaagaagccatgatcaagcttggtttccacttgctctgcttcttcatgtatctttatagtggtagcaactgcccttgctaa

SEQ ID NO: 676 - DNA, 1234 bp, Artificial Sequence
  Synthetic polynucleotide
tacactgaaattcatagtaacattgttcacaatagccaaaaggagagaacaacccaaatgttcatcaaaaataaaatgtggtatatccatacaatggaatattatgcagccataaaatggaatgaaattttcatgtacactgtaacatgaatgtaccatgaaaacattatgcttactgaaataatccagataaataaagacaaatactgtatgattccacatatatgaggcatctaaagtagccaaatttatagaaacggaaaatagaatggcagttgccaggggctgagggaagaagaaaaacataagtgtttattgtgtataaagttttaattttataagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggatttggtatcagcactaaattgtgggattactgtttccacaccctcactccagagaaaccccacctgaagacgcagtga

SEQ ID NO: 677 - DNA, 586 bp, Artificial Sequence
  Synthetic polynucleotide
tacactgaaattcatagtaacattgttcacaatagccaaaaggagagaacaacccaaatgttcatcaaaaataaaatgtggtatatccatacaatggaatattatgcagccataaaatggaatgaaattttcatgtacactgtaacatgaatgtaccatgaaaacattatgcttactgaaataatccagataaataaagacaaatactgtatgattccacatatatgaggcatctaaagtagccaaatttatagaaacggaaaatagaatggcagttgccaggggctgagggaagaagaaaaacataagtgtttattgtgtataaagttttaattttataagatgaaaaggttctggagatggatggcagtgatggttgcacaagggctccatggagaacgagcctgtagcccttgaggaaactcagaagacagatcctgctatggaaccacggttcaaagtggtggattgggacaagagtacacggtggcagtgcccaagtccatgttccccgggctcttcatgctggggacattcctctggagcctcatcgagtacctcatccaccgcttcctgttccacatga

SEQ ID NO: 678 - DNA, 890 bp, Artificial Sequence
  Synthetic polynucleotide
tacactgaaattcatagtaacattgttcacaatagccaaaaggagagaacaacccaaatgttcatcaaaaataaaatgtggtatatccatacaatggaatattatgcagccataaaatggaatgaaattttcatgtacactgtaacatgaatgtaccatgaaaacattatgcttactgaaataatccagataaataaagacaaatactgtatgattccacatatatgaggcatctaaagtagccaaatttatagaaacggaaaatagaatggcagttgccaggggctgagggaagaagaaaaacataagtgtttattgtgtataaagttttaattttataagatgaaaaggttctggagatggatggcagtgatggttgcacaagggctccatggagaacgagcctgtagcccttgaggaaactcagaagacagatcctgctatggaaccacggttcaaagtggtggattgggacaaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtacagtgtccccatcatctgggtgcccctggtgctgtatctcagctggtcctactaccgaacctttgcccagggcaacgtccgactcttcacgtcatttacaacagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggcc

SEQ ID NO: 679 - DNA, 515 bp, Artificial Sequence
  Synthetic polynucleotide
tgataaggttagcctttgtgtccccacccaaatctcatcttgaaatgtaatccccaggtgttgagggagagaccttgtgggaggtgattggatcatgggggcagtttccccatgctgttcttgtgatagcgagtgagttcccaggacatctgatgtatttataagtgtttgatagttcctctcttgcttgcttcttctctctcctgccatcctgtgaagaggtgccttctgtcatgattcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactga

SEQ ID NO: 680 - DNA, 407 bp, Artificial Sequence
  Synthetic polynucleotide
tgataaggttagcctttgtgtccccacccaaatctcatcttgaaatgtaatccccaggtgttgagggagagaccttgtgggaggtgattggatcatgggggcagtttccccatgctgttcttgtgatagcgagtgagttcccaggacatctgatgtatttataagtgtttgatagttcctctcttgcttgcttcttctctctcctgccatcctgtgaagaggtgccttctgtcatgattcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaa

SEQ ID NO: 681 - DNA, 485 bp, Artificial Sequence
  Synthetic polynucleotide
tgataaggttagcctttgtgtccccacccaaatctcatcttgaaatgtaatccccaggtgttgagggagagaccttgtgggaggtgattggatcatgggggcagtttccccatgctgttcttgtgatagcgagtgagttcccaggacatctgatgtatttataagtgtttgatagttcctctcttgcttgcttcttctctctcctgccatcctgtgaagaggtgccttctgtcatgattcatcctggtggggaagaagttttaagggaacaagctggaggtgacgctactgagaactttgaggatgtcgggcactctacagatgccagggaaatgtccaaaacattcatcattggggagctccatccagaaactcttatcactactattgattctagttccagttggtggaccaactgggtgatccctgccatctctgcagtggccgtcgccttgatgtatcgcctatacatggcagaggactga

SEQ ID NO: 682 - DNA, 380 bp, Artificial Sequence
  Synthetic polynucleotide
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggtaggggctgatgcttaa

SEQ ID NO: 683 - DNA, 422 bp, Artificial Sequence
  Synthetic polynucleotide
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtga

SEQ ID NO: 684 - DNA, 271 bp, Artificial Sequence
  Synthetic polynucleotide
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgttttccaggtcaggtgggggcaagtgtccttcaggagtgggagcttgggaggcagagcctgtagcagctctcctgatcagcactccttcctaaa

SEQ ID NO: 685 - DNA, 197 bp, Artificial Sequence
  Synthetic polynucleotide
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctggaggaggagactgccattga

SEQ ID NO: 686 - DNA, 524 bp, Artificial Sequence
  Synthetic polynucleotide
actggacctggaatctggcttggtcttggaatctgggctctaccaggtcacttttcaataggatggactttgaagacttggggttggtagtagattgggaccaccacctgcctccaccagctgccaagactgtggttgagaacctccccaggacagtcatcagaggctctcaggctgctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaa

SEQ ID NO: 687 - DNA, 2194 bp, Artificial Sequence
  Synthetic polynucleotide
atatggtttggctgtgtcccaacccaaatctcaacttgagttgtatctcccagaattcccacatgtgggagggacccagggggaggtaatcaaatcatgggggctggtttttcctgtgctattctcatgatagtgaataagtctcacaagatcttatgggtttataaggggtttccgcttttgcttcctcctcatttctctcttgctgcaaccatgtaagaagtgccttccaccctctgccatgattgtgagatcttccccagccatgtggaactgaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtga

SEQ ID NO: 688 - DNA, 362 bp, Artificial Sequence
  Synthetic polynucleotide
atatggtttggctgtgtcccaacccaaatctcaacttgagttgtatctcccagaattcccacatgtgggagggacccagggggaggtaatcaaatcatgggggctggtttttcctgtgctattctcatgatagtgaataagtctcacaagatcttatgggtttataaggggtttccgcttttgcttcctcctcatttctctcttgctgcaaccatgtaagaagtgccttccaccctctgccatgattgtgagatcttccccagccatgtggaactgaatgggaagatacagtgcagtcggaagtgttactgagagaattttcacattatactatgatcacttgggattcctacataagctga

SEQ ID NO: 689 - DNA, 781 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 690 - DNA, 844 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 691 - DNA, 781 bp, Artificial Sequence; identical to SEQ ID NO: 689
  Synthetic polynucleotide

SEQ ID NO: 692 - DNA, 701 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 693 - DNA, 812 bp, Artificial Sequence
  Synthetic polynucleotide
gggaaatagcttactatgagtctcaggagtcttccctgtgaaacctggcagtaccgcatgcctcccagagctgtacaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtag

SEQ ID NO: 694 - DNA, 752 bp, Artificial Sequence
  Synthetic polynucleotide
gggaaatagcttactatgagtctcaggagtcttccctgtgaaacctggcagtaccgcatgcctcccagagctgtacaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtag

SEQ ID NO: 695 - DNA, 1718 bp, Artificial Sequence
  Synthetic polynucleotide
cagtacaggacagtgattaaacgcgtcgaccacattgcctgggtttgaatcctgccgctgcttttgagtagctccttgagcttggacaagtttcttagcttttctgtacctgtttccctgtctaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagagtttttttcatttatttga

SEQ ID NO: 696 - DNA, 1769 bp, Artificial Sequence
  Synthetic polynucleotide
cagtacaggacagtgattaaacgcgtcgaccacattgcctgggtttgaatcctgccgctgcttttgagtagctccttgagcttggacaagtttcttagcttttctgtacctgtttccctgtctaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaa

SEQ ID NO: 697 - DNA, 1763 bp, Artificial Sequence
  Synthetic polynucleotide
cagtacaggacagtgattaaacgcgtcgaccacattgcctgggtttgaatcctgccgctgcttttgagtagctccttgagcttggacaagtttcttagcttttctgtacctgtttccctgtctaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctga

SEQ ID NO: 698 - DNA, 1769 bp, Artificial Sequence; identical to SEQ ID NO: 696
  Synthetic polynucleotide

SEQ ID NO: 699 - DNA, 1763 bp, Artificial Sequence; identical to SEQ ID NO: 697
  Synthetic polynucleotide

SEQ ID NO: 700 - DNA, 1763 bp, Artificial Sequence; identical to SEQ ID NO: 697
  Synthetic polynucleotide

SEQ ID NO: 701 - DNA, 394 bp, Artificial Sequence
  Synthetic polynucleotide
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggcatttggagttcctgttcactctacctggatgcattttaactaa

SEQ ID NO: 702 - DNA, 700 bp, Artificial Sequence
  Synthetic polynucleotide
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaatag

SEQ ID NO: 703 - DNA, 568 bp, Artificial Sequence
  Synthetic polynucleotide
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggatatcactactttaactggagttccagaagagcatataaaaactag

SEQ ID NO: 704 - DNA, 535 bp, Artificial Sequence
  Synthetic polynucleotide
gcttttcacggttttagttacccacggtcagctgtggtccaaaaatatgcagtggaaaattcccaaaacaaacaatttatgaatttaatatttgctccattctgagtagtgtgatgaaatctcatgccgtccagctctgtctcacccaggatgtgaatcatccctttgtctagtgtatccaggttgtataggatacctgcgttagtcagaacttagtagccatcttggtgataagattgaccgtctcagtattgcagtgcttgtgttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgatggagctatga

SEQ ID NO: 705 - DNA, 129 bp, Artificial Sequence
  Synthetic polynucleotide
ttcaagtcgttgaggacttccacatggagattggcacaggaccagactcaagacacacaactcataacagttgatgaaaaattggcatttggagttcctgttcactctacctggatgcattttaactaa

SEQ ID NO: 706 - DNA, 435 bp, Artificial Sequence
  Synthetic polynucleotide
ttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaatag

SEQ ID NO: 707 - DNA, 303 bp, Artificial Sequence
  Synthetic polynucleotide
ttcaagtcgttgaggacttccacatggagattggcacaggaccagactcaagacacacaactcataacagttgatgaaaaattggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggatatcactactttaactggagttccagaagagcatataaaaactag

SEQ ID NO: 708 - DNA, 270 bp, Artificial Sequence
  Synthetic polynucleotide
ttcaagtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgatggagctatga

SEQ ID NO: 709 - DNA, 3055 bp, Artificial Sequence
  Synthetic polynucleotide
gactcagattcgaatcctggctttgctacatactacctgtgtgaggctctttaagcctcagtgacctcatctgtgaaatggtgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 710 - DNA, 3058 bp, Artificial Sequence
  Synthetic polynucleotide
gactcagattcgaatcctggctttgctacatactacctgtgtgaggctctttaagcctcagtgacctcatctgtgaaatggtgtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaagggcctgcggaacccgctgcagaggcgtcggatgaggccgagcggcgcgcccgtggctgccacctgcagtaccagcgggccggtgtgcgcttcctcgcccccttcgcggcccacccgctggacggcggccgccgcctcacgcacctgcttggccccgactggctgctagacgtgtcccacctcgtggcgccacacgcccgcgtgctggactcgcgtgtagcctctctggagggtggccgtgtcgtggtgggccgggagcccggtgtcacctccattgaggtgcgttccccactgtctgactccatcctgggggagcaggcgctggctgtgacggacgacaaggtctcagtgctggagctgagggtgcagccagtgatgggcatctcgctgaccttgagccggggcactgcccaccccggggaggtcacagctacgtgctgggcacagtcagcccttcccgccccaaagcaggaggtggccctctccctatggctgtccttctctgatcacactgtggccccagctgagctctacgaccgccgtgacctgggactgtccgtctcagccgaggagcctggtgccatcctgccagctgaggagcagggtgcccagctcggggtggtggtgagtggggcaggcgccgaggggctgccgctgcatgtggctctgcacccgcccgagccctgccgccggggccgccaccgtgtgcctctggcctctggcaccgcctggctggggctgccccctgcctccactccagcccctgctctcccatccagccctgcttggagcccaccagccacagaagccaccatgggtggtaaacggcaggtggcaggcagtgtcgggggcaacacaggtgtgaggggcaagtttgagcgggcagaggaggaggccaggaaggaggagaccgaagccagggaggaggaggaggaagaggaggaggagatggtccctgcccctcagcatgtcactgagctagagctgggcatgtacgccctgctgggagtcttctgcgtggccatcttcatcttcttggtcaatggtgtggtcttcgtcctgcgctatcagcgcaaagaacctcccgacagtgccactgaccccacctccccccagccccacaactgggtctggctgggcactgaccaggaggaactgagccgccagctggaccggcagtcccctggcccgcccaagggggaggggagctgcccctgtgagagtgggggaggaggggaggcccctaccctggcccctggccctcctgggggcaccaccagctcctcaagcaccctggcccgaaaggaggctggggggcggcggaagcgagtagagtttgtgacatttgcgccagcccctccagcccagtcacctgaggagcctgtaggggcccctgctgtgcagtccatccttgtggcaggcgaggaggacatccgctgggtgtgtgaggacatggggctgaaggaccctgaggagcttcgcaactacatggagaggatccggggcagctcctga

SEQ ID NO: 711 - DNA, 970 bp, Artificial Sequence
  Synthetic polynucleotide
cagagtggcacctgaagaactcgtcttgcatttggctgtcaaagtcgccaaccaggcttccctgcctctggtggatttcatcatccagaacggtggtcacctggatgccaaggctgctgacgggaacacggctctgcactacgcagcactctacaaccagcccgactgcctcaagctgctgctgaaggggagagctttggttggcacagtaaatgaagcaggcgagacagctctggacatagccaggaagaagcaccacaaggagtgtgaggagctgctggagcaggcccaggcggggacctttgccttccctctacatgtggactactcctgggtaatttccacagagcctggctctgacagtgaggaggatgaggaagagaagcgctgcttgctgaagctcccggcccaggctcactgggccagtgggaggctggacatcagcaacaagacctatgagactgtcgccagcctgggagcagccacccctcagggcgagagtgaggactgtcccccgcccttgccagtcaaaaactcttctcggactttggtccaagggtgtgcaagacatgccagtggagatcgttctgaagtctccagcctgagttcagaggcccctgagacccctgagagcctgggcagtccagcctcctcctccagtctgatgagccccttggaacctggggatcccagccaagccccacccaactctgaagagggcctccgagagcccccaggcacctccagacccagcctgacatccgggaccaccccttcggagatgtacctccccgtcagattcagctccgagagcactcgctcctatcggcggggggcgcggagccctgaagatggtccctcagccaggcagcctctgcccagaaggaacgtgccggttggcatcactgaaggagatggctcaaggactgggagtctcccagcaagttctgtgcaacttttgcaagactag

SEQ ID NO: 712 - DNA, 970 bp, Artificial Sequence; identical to SEQ ID NO: 711
  Synthetic polynucleotide

SEQ ID NO: 713 - DNA, 970 bp, Artificial Sequence; identical to SEQ ID NO: 711
  Synthetic polynucleotide

SEQ ID NO: 714 - DNA, 1681 bp, Artificial Sequence
  Synthetic polynucleotide
aaaaggagccattagaactcacggagtccagcaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 715 - DNA, 1681 bp, Artificial Sequence; identical to SEQ ID NO: 714
  Synthetic polynucleotide

SEQ ID NO: 716 - DNA, 1681 bp, Artificial Sequence; identical to SEQ ID NO: 714
  Synthetic polynucleotide

SEQ ID NO: 717 - DNA, 1543 bp, Artificial Sequence
  Synthetic polynucleotide
aaaaggagccattagaactcacggagtccagcaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcagaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatga

SEQ ID NO: 718 - DNA, 1681 bp, Artificial Sequence; identical to SEQ ID NO: 714
  Synthetic polynucleotide

SEQ ID NO: 719 - DNA, 258 bp, Artificial Sequence
  Synthetic polynucleotide
aaaaggagccattagaactcacggagtccagcaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcag

SEQ ID NO: 720 - DNA, 1027 bp, Artificial Sequence
  Synthetic polynucleotide
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaattttaaaacaacaattaagtggattatgggaacaggaaaaccatcttactttggttccaggatatactggtaatatagctaaggatgtagatgcttatttattacagttacattga

SEQ ID NO: 721 - DNA, 648 bp, Artificial Sequence
  Synthetic polynucleotide
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtataagtga

SEQ ID NO: 722 - DNA, 643 bp, Artificial Sequence
  Synthetic polynucleotide
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaagttcatcatccctttccaaatccttgttacagaaaaaaacagtcccctggaagtgggggctgtgacatggcaaataaagaaaatgaactggcttgtgcaggccacctgcctgaaaaattacaccatgatagtcgaacatatttggttaactccagtgattctggttcttcacagacagaaagcccatcatcaaaatatagtgggtttttttctgaggtttctcaggaccatgaaacaatggcccaagttttgttcagcaggaatatgagattgaatgtagctttaactttctggagaaagagaagtata

SEQ ID NO: 723 - DNA, 335 bp, Artificial Sequence
  Synthetic polynucleotide
aatttgggggccagtccgggattcccattctcctctgggcaagggtccctggtcctctcccatgaggaggcacgccctgcagcctcattgcggtggccttgtgtaaggaatcgaggcccacccagtgtgatgaataaacccggactctcagcaacgcaggaagaaacagaccaacaacttgggggaaaaaaaataatcacataccaggtaaccctgtgcatagaccaaggttaagaaatctccaaaacagttggctgcttacataaatagaacagttggacaaactgtgaaaagcccagataaacttcgtaaagtgatctatcgcagaaagaaag

SEQ ID NO: 724 - DNA, 767 bp, Artificial Sequence
  Synthetic polynucleotide
ggccaggtgcggtcgctcacacctgtaatcccagcactttgggaggccgaggcgggcagatcacgaggtcaggagatcgagaccatcttggctaacacagagaaaccccatctctactaaaaatacgaaaaattagccgggcgtggtggcgggcgcctgtagtcccagctactccggaggctgatgcaggagaatgcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctga

SEQ ID NO: 725 - DNA, 767 bp, Artificial Sequence; identical to SEQ ID NO: 724
  Synthetic polynucleotide

SEQ ID NO: 726 - DNA, 767 bp, Artificial Sequence; identical to SEQ ID NO: 724
  Synthetic polynucleotide

SEQ ID NO: 727 - DNA, 767 bp, Artificial Sequence; identical to SEQ ID NO: 724
  Synthetic polynucleotide

SEQ ID NO: 728 - DNA, 767 bp, Artificial Sequence; identical to SEQ ID NO: 724
  Synthetic polynucleotide

SEQ ID NO: 729 - DNA, 1211 bp, Artificial Sequence
  Synthetic polynucleotide
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacaaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 730 - DNA, 806 bp, Artificial Sequence
  Synthetic polynucleotide
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacaaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctga

SEQ ID NO: 731 - DNA, 1175 bp, Artificial Sequence
  Synthetic polynucleotide
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacaaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 732 - DNA, 1211 bp, Artificial Sequence; identical to SEQ ID NO: 729
  Synthetic polynucleotide

SEQ ID NO: 733 - DNA, 1680 bp, Artificial Sequence
  Synthetic polynucleotide
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 734 - DNA, 1584 bp, Artificial Sequence
  Synthetic polynucleotide
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 735 - DNA, 1584 bp, Artificial Sequence; identical to SEQ ID NO: 734
  Synthetic polynucleotide

SEQ ID NO: 736 - DNA, 1494 bp, Artificial Sequence
  Synthetic polynucleotide
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 737 - DNA, 1491 bp, Artificial Sequence
  Synthetic polynucleotide
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 738 - DNA, 1482 bp, Artificial Sequence
  Synthetic polynucleotide
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 739 - DNA, 1485 bp, Artificial Sequence
  Synthetic polynucleotide
ctccataaggacaaggactttggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 740 - DNA, 1494 bp, Artificial Sequence; identical to SEQ ID NO: 736
  Synthetic polynucleotide

SEQ ID NO: 741 - DNA, 1491 bp, Artificial Sequence; identical to SEQ ID NO: 737
  Synthetic polynucleotide

SEQ ID NO: 742 - DNA, 59 bp, Artificial Sequence
  Synthetic polynucleotide
taccagagtgcctggcacatagttggtgcttcataaaggaaaactgggagaaaacatga

SEQ ID NO: 743 - DNA, 123 bp, Artificial Sequence
  Synthetic polynucleotide
taccagagtgcctggcacatagttggtgcttcataaaggaaaactgggagaaaacatgattcttaaacgagctgcatgggtgaaggtgccatctgggttctacgttggctcttatgtccacgg

SEQ ID NO: 744 - DNA, 445 bp, Artificial Sequence
  Synthetic polynucleotide
taccagagtgcctggcacatagttggtgcttcataaaggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaatag

SEQ ID NO: 745 - DNA, 445 bp, Artificial Sequence; identical to SEQ ID NO: 744
  Synthetic polynucleotide

SEQ ID NO: 746 - DNA, 445 bp, Artificial Sequence; identical to SEQ ID NO: 744
  Synthetic polynucleotide

SEQ ID NO: 747 - DNA, 677 bp, Artificial Sequence
  Synthetic polynucleotide
gcaccagcaagggttctgtttctgtttctggagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaa

SEQ ID NO: 748 - DNA, 674 bp, Artificial Sequence
  Synthetic polynucleotide
gcaccagcaagggttctgtttctgtttctggagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaa

SEQ ID NO: 749 - DNA, 400 bp, Artificial Sequence
  Synthetic polynucleotide
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacg

SEQ ID NO: 750 - DNA, 2301 bp, Artificial Sequence
  Synthetic polynucleotide
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 751 - DNA, 2381 bp, Artificial Sequence
  Synthetic polynucleotide
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctga

SEQ ID NO: 752 - DNA, 692 bp, Artificial Sequence
  Synthetic polynucleotide
gccgagcaccgtggctcatacttgtagtcccagtactttgggaggctgaggcggatggatcctttgaggtcaggagttaaagaccagcgcggccaacatgacgaaactccgtctctactaagaacacaacagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctggga

SEQ ID NO: 753 - DNA, 852 bp, Artificial Sequence
  Synthetic polynucleotide
ggccgggcacagtagctcacacctgtaatcccagcactttggaaggccgagaatgaacatgaagtgggggaagccatccaagagaagatccaagagaaggctgtgaagcgggaggacctgttcatcgtcagcaagttgtggcccactttctttgagagaccccttgtgaggaaagcctttgagaagaccctcaaggacctgaagctgagctatctggacgtctatcttattcactggccacagggattcaagtctggggatgaccttttccccaaagatgataaaggtaatgccatcggtggaaaagcaacgttcttggatgcctgggaggccatggaggagctggtggatgaggggctggtgaaagcccttggggtctccaatttcagccacttccagatcgagaagctcttgaacaaacctggactgaaatataaaccagtgactaaccaggttgagtgtcacccatacctcacacaggagaaactgatccagtactgccactccaagggcatcaccgttacggcctacagccccctgggctctccggatagaccttgggccaagccagaagacccttccctgctggaggatcccaagattaaggagattgctgcaaagcacaaaaaaaccgcagcccaggttctgatccgtttccatatccagaggaatgtgattgtcatccccaagtctgtgacaccagcacgcattgttgagaacattcaggtctttgactttaaattgagtgatgaggagatggcaaccatactcagcttcaacagaaactggagggcctgtaacgtgttgcaatcctctcatttggaagactatcccttcaatgcagaatattga

SEQ ID NO: 754 - DNA, 1036 bp, Artificial Sequence
  Synthetic polynucleotide
gacaccaaaagcttgaaccataagtcaaaaaattgaaaattggacttcatcagaataaacttttgctcttccaagacaccactaagaaaatgacaagatagcacagacagcatatatatatatcagacaaaggtttagtatccagaatgtgtaaagaatagcttaagaaggcaaacaacccaataagaaaagggacttatatgatttatgcagataatttataagagaagataaaaatggccaagaagcacatgaaaagatactcaacattaccctagtcattgggggataacaaattaaaccactacatatccattacaatatctaaaatcagaaaacaaatgaaaaccccccaaaaccaaaatttgtgtgatgcatctggaactcttatgctctgatggtgagagagtaaaatgttacaaccgctttggaaaacaatccagggtttccttaaaaagtcaaatatctatttactgtaggaactagccatccaaccttaggtatttacccaagggaaatgaaaatacatgtctgcacaaagactcttacacaaatgtttattgcagtttcatttctaatgtcaaaaactggaaacaacctatatgtgtgttaacaggtgaatggataaagaaatcgtggtgcattcacacagtggaagactgctcggtggtagacactactgacgcatgcggtgatgtgggtgggtctcaaaatagtgaaggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtga

SEQ ID NO: 755 - DNA, 204 bp, Artificial Sequence
  Synthetic polynucleotide
cagtgttttttaaactttgctttagaacttgtttggaacttgtcataaaatcgatcagtttggtgaattgcaaccaacaatatttaaaaagaaaacagaacagaacaaaatatcaggatgcaatgtgcatgcctaaatggaaacctgataaaaccagaggaggccaaagtctatgaagatgagaagcggattatctgtttctga

SEQ ID NO: 756 - DNA, 564 bp, Artificial Sequence
  Synthetic polynucleotide
acacaattgttcacagaagtattataaccaaaaagtggcaacaactcatacgtccatcagctgatgaatggataaaatatggtgtaatcacacagtggaacgttattcagtcataggaagaaagtgctgatccacgctgcagcctggatgagccttgaaaacaccatgcgaagtggaagaagccggagacgaaaggccgcgtgttgtgtgatctcatctatatgagccgtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctga

SEQ ID NO: 757 - DNA, 564 bp, Artificial Sequence; identical to SEQ ID NO: 756
  Synthetic polynucleotide

SEQ ID NO: 758 - DNA, 564 bp, Artificial Sequence; identical to SEQ ID NO: 756
  Synthetic polynucleotide

SEQ ID NO: 759 - DNA, 597 bp, Artificial Sequence
  Synthetic polynucleotide
ccttagagccttaggctccactttcttcctcagctgccacatccaaaccatggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaa

SEQ ID NO: 760 - DNA, 654 bp, Artificial Sequence
  Synthetic polynucleotide
ccttagagccttaggctccactttcttcctcagctgccacatccaaaccatggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaa

SEQ ID NO: 761 - DNA, 1175 bp, Artificial Sequence
  Synthetic polynucleotide
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 762 - DNA, 770 bp, Artificial Sequence
  Synthetic polynucleotide
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgatgacacagtttatctctttgttgtaaaccacccagaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtatatctatgttgctga

SEQ ID NO: 763 - DNA, 1139 bp, Artificial Sequence
  Synthetic polynucleotide
atatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattaagctggctctgaagatattgacatacttcccaatggtctggctttttttagtgtgggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacgaattcaagaatacagtggaaatttttaaatttgaagaagcagaaaattctctgttgcatctgaaaacagtcaaacatgagcttcttccaagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatatctatgttgctgacatattggctcatgaaattcatgttttggaaaaacacactaatatgaatttaactcagttgaaggtacttgagctggatacactggtggataatttatctattgatccttcctcgggggacatctgggtaggctgtcatcctaatggccagaagctcttcgtgtatgacccgaacaatcctccctcgtcagaggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaa

SEQ ID NO: 764 - DNA, 1175 bp, Artificial Sequence; identical to SEQ ID NO: 761
  Synthetic polynucleotide

SEQ ID NO: 765 - DNA, 1217 bp, Artificial Sequence
  Synthetic polynucleotide
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 766 - DNA, 1139 bp, Artificial Sequence
  Synthetic polynucleotide
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 767 - DNA, 1217 bp, Artificial Sequence; identical to SEQ ID NO: 765
  Synthetic polynucleotide

SEQ ID NO: 768 - DNA, 847 bp, Artificial Sequence
  Synthetic polynucleotide
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 769 - DNA, 665 bp, Artificial Sequence
  Synthetic polynucleotide
caagagtggttgaggcttggcacttgccacctagatttcagacaatgtgtcaggaatcctggatgcccagaaagaaacctgctcagggtctggagccccaacataaagcttttatttaggcaatgttgagcactaatatgtggttggagctctgcagggggtctccatgggtgcactgtgtagcaaagctgtgggagaaaggccttacccctcaaaattccagaattataaatctatcagccgcttgcaacttcagcctggaaaagccatgggcattaaactccaaactgtgagagcagccatgtgggctgcaccctgcaaagccacaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 770 - DNA, 318 bp, Artificial Sequence
  Synthetic polynucleotide
caggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatac

SEQ ID NO: 771 - DNA, 1471 bp, Artificial Sequence
  Synthetic polynucleotide
caggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctga

SEQ ID NO: 772 - DNA, 1366 bp, Artificial Sequence
  Synthetic polynucleotide
caggcatacctcgttttattatgcttcgccttattgcactttgcagatgttgcattttttcaaattgagagtttgtggcaagcctgccttgagcaagtctatgggagccatttttccaacagcatgtgctcacttcctgtctctgtgtctcattttgaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaaggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctga

SEQ ID NO: 773 - DNA, 299 bp, Artificial Sequence
  Synthetic polynucleotide
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaagtga

SEQ ID NO: 774 - DNA, 503 bp, Artificial Sequence
  Synthetic polynucleotide
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaagtttgttgataagccggggcccttcgtgggaccctgcggtcactggatcaggccctcagagaccctgcagaagtacctgaaggtggtgatggccctcacgtatgaggagaagccgccctacgccatgctgaggaacaacctagaagctttgctgcaggatctgcgtgtgtctccatatgaccccattggcctcccgatggtgccctag

SEQ ID NO: 775 - DNA, 503 bp, Artificial Sequence; identical to SEQ ID NO: 774
  Synthetic polynucleotide

SEQ ID NO: 776 - DNA, 503 bp, Artificial Sequence; identical to SEQ ID NO: 774
  Synthetic polynucleotide

SEQ ID NO: 777 - DNA, 503 bp, Artificial Sequence; identical to SEQ ID NO: 774
  Synthetic polynucleotide

SEQ ID NO: 778 - DNA, 503 bp, Artificial Sequence; identical to SEQ ID NO: 774
  Synthetic polynucleotide

SEQ ID NO: 779 - DNA, 503 bp, Artificial Sequence; identical to SEQ ID NO: 774
  Synthetic polynucleotide

SEQ ID NO: 780 - DNA, 317 bp, Artificial Sequence
  Synthetic polynucleotide
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaagttgccttgggattcattttaa

SEQ ID NO: 781 - DNA, 317 bp, Artificial Sequence; identical to SEQ ID NO: 780
  Synthetic polynucleotide

SEQ ID NO: 782 - DNA, 344 bp, Artificial Sequence
  Synthetic polynucleotide
aactgtcagagtctcccccgccctcccccactgaggctgggtttggtacccatccttctgggctcccgtgtgttctgtgtcctttgtcactcaggtagtcgcacgctatagctgtctccccactaggctgtcacgggctgggacccgacgagatcctggtctgggttttcagaaggccctcccgccgcagcgacctccagagcctgggctactgcatgctgaagtggctctacgggtttctgccatggacaaattgccttcccaacactgaggacatcatgaagcaaaaacagaaatgtatttgtaccctcaaaatcgcatgctggccgtggtgctgtgtgtga

SEQ ID NO: 783 - DNA, 1328 bp, Artificial Sequence
  Synthetic polynucleotide
tgttaaagtgaaccccaagtttctcttcaaagaatcagtaagttcaggtctcttactctttgattcactattttaaagtttaacttcctggttctcttcgccctcttgcttctagtttcagtaaacaaccttttccaccagttttaatcagtagttcacatctgttcccccggtcacctactccgtcctgactcatcccggtcacctgctttgacctgagtcaccctggtcacctgctctgacctaagtcacctttaattacctgttcctaactgtccttcccaccaaactactcaccccaccactctggctcataaacctgttccctttaaaatagccaatcagaattagcttagactgtgtggttcaaccctagccaataggggaacgacatagcagtagggactacctgcgtcagaaataagaactccttcccctcccctgtccagttgtgttctcaccattgttccatctgcgaggagcaccctttctgcagaaagtaaaaattgccttgctgaggaaattaaatatagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcagcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtga

SEQ ID NO: 784 - DNA, 1325 bp, Artificial Sequence
  Synthetic polynucleotide
tgttaaagtgaaccccaagtttctcttcaaagaatcagtaagttcaggtctcttactctttgattcactattttaaagtttaacttcctggttctcttcgccctcttgcttctagtttcagtaaacaaccttttccaccagttttaatcagtagttcacatctgttcccccggtcacctactccgtcctgactcatcccggtcacctgctttgacctgagtcaccctggtcacctgctctgacctaagtcacctttaattacctgttcctaactgtccttcccaccaaactactcaccccaccactctggctcataaacctgttccctttaaaatagccaatcagaattagcttagactgtgtggttcaaccctagccaataggggaacgacatagcagtagggactacctgcgtcagaaataagaactccttcccctcccctgtccagttgtgttctcaccattgttccatctgcgaggagcaccctttctgcagaaagtaaaaattgccttgctgaggaaattaaatatagcttaaggattctgagttgaagagcacagagctgcaggagaaagtgactgagctggagagtttgctggaggagacccaggcaatctgcagagagaaggagattcaactggaaagcctgaggcagagagaagcagaattctcctccgctggacatagcctgcaagataaacagtctgtggaggagaccagtggagaaggtccagaagtggaaatggagtcctggcagaagcgatacgattcgctccaaaagattgtggagaagcagcagcagaagatggatcagttgcgctcacaagtacagagcctagagcaggaagtggctcaagaagaaggaacaagccaggccctgagagaggaggcccagcgaagggattcagccctgcagcagctgcgcacagccgtgaaggagctttcagtgcaaaaccaggacttgattgagaagaatctgacactccaggaacacctgcgccaggcccaaccagggtctccaccttcaccagacacggcccagctggcacttgagctgcaccaggagttggccagttgccttcaagatctgcaggctgtctgtagcattgtgacccagagggcccagggccatgaccccaatctctccctgctcctgggcattcactcacagcacccagagactcagctagatttgcagaagccagatgtgatcaagaggaaactagaagaggttcaacagctgcgtcgtgacattgaggacttaaggaccaccatgtcagacagatatgcccaggacatgggagaaaactgtgtcacacagtga

SEQ ID NO: 785 - DNA, 1328 bp, Artificial Sequence; identical to SEQ ID NO: 783
  Synthetic polynucleotide

SEQ ID NO: 786 - DNA, 1325 bp, Artificial Sequence; identical to SEQ ID NO: 784
  Synthetic polynucleotide

SEQ ID NO: 787 - DNA, 541 bp, Artificial Sequence
  Synthetic polynucleotide
gaaacctggctctgccacttcccaaggtgcctcaatggtccggccaccagttgtgcctcggcgccccccggcccacatcagcagtgtcaggcaggcctccacccaggtgccacgcacggtgcctcatacccagagagtagccaacattggtactcagaccacaggacccagtggggtaggatgctgtacaccaggccggccgctcctgccgtgcaaatgttcctcagcagcacatagcacctatcgggtccaggagccggctgtgcacatcccaggacaggagcccctgaccgcgtccatgctggctgcggcgcccctgcatgagcaaaagcagatgattggggagcgtctctacccccttatccatgatgtccacacccagctggctggcaagatcacgggcatgctgctggagattgacaactcagagctgttgctcatgctggagtctccagaatccctccatgccaagatagacgaggcagtggccgtgctgcaggcacaccaggctatggagcagccgaaggcgtacatgcactga

SEQ ID NO: 788 - DNA, 541 bp, Artificial Sequence; identical to SEQ ID NO: 787
  Synthetic polynucleotide

SEQ ID NO: 789 - DNA, 1052 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 790 - DNA, 974 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 791 - DNA, 1052 bp, Artificial Sequence; identical to SEQ ID NO: 789
  Synthetic polynucleotide

SEQ ID NO: 792 - DNA, 682 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 793 - DNA, 500 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 794 - DNA, 1024 bp, Artificial Sequence
  Synthetic polynucleotide
gtggccttggccaacacccaaggcctctctggacttcatgacaccaactgtaatatgaagataatcataatagtgaccttgtaagaagtttttgaggattaagttaaaaatacatctgaagggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtga

SEQ ID NO: 795 - DNA, 1279 bp, Artificial Sequence
  Synthetic polynucleotide
ctctccctctccctctccctctccctcgccctctcccctttccacggtctcccctctccctctctttccacggtctccctctcacgccgagccgaagctggactgtactgccgccatctcggctcactgcagcctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccacgagtgatccgccagcctcggcctcctgaggtgccgggattgcagacagagtctcgttaactcagtgctcaatggtgcccaggctggagtgcagtggcgtgatctcggctccctgcagcctccacctcccagccgcctgccttggccccccacagtgccgagattgcagcctctgcccggccgccactccgtctgggaagtgaggagcgtctctgcctggccgcccatcgtctgggatgtgaggagcccctctgcctggctgcccagtctggaaagtgaggagcctctctgcccggccgccatcccacctaggaagtgaggagcgcctcttcccggccgccatcccatctaggaagtgaggagcgtctctgcccggccgccccgtctgagaagtgaggagaccctccgcctggcaactgccccgtctgagaagtgaggagcccctccgcccggcagctgccccgtctgagaagtgaggagcccctccgcccggctgacaccccgtctgggaagtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtga

SEQ ID NO: 796 - DNA, 590 bp, Artificial Sequence
  Synthetic polynucleotide
gccttttggaaactcagggcagctctgtggattgtcacagcaactggagctcctgctgtattttcaggatggtcccgggaggcaggtgttctgcagccatggggcactcccttagcaatgaagactggccccccattccacttgacttctgaatgtccctgggacactcatgagagtccgaagcctgtttatgatgacctgagcctcatcccaagtgcattgtggacacacacaggagacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatag

SEQ ID NO: 797 - DNA, 590 bp, Artificial Sequence; identical to SEQ ID NO: 796
  Synthetic polynucleotide

SEQ ID NO: 798 - DNA, 590 bp, Artificial Sequence; identical to SEQ ID NO: 796
  Synthetic polynucleotide

SEQ ID NO: 799 - DNA, 590 bp, Artificial Sequence; identical to SEQ ID NO: 796
  Synthetic polynucleotide

SEQ ID NO: 800 - DNA, 590 bp, Artificial Sequence; identical to SEQ ID NO: 796
  Synthetic polynucleotide

SEQ ID NO: 801 - DNA, 590 bp, Artificial Sequence; identical to SEQ ID NO: 796
  Synthetic polynucleotide

SEQ ID NO: 802 - DNA, 590 bp, Artificial Sequence; identical to SEQ ID NO: 796
  Synthetic polynucleotide

SEQ ID NO: 803 - DNA, 463 bp, Artificial Sequence
  Synthetic polynucleotide
ggccaggcacggtggctcacgcctgtaatcccagcactttgggaggccgaggcaggcggatcacctgaggtcaggagttcgagaccagcctgaccacatggagaaaccccgcctctgctaaaagtacaaaattagccaggcgtggtggcaggagcctgtaattccagctactcaggagactgaggcaggagaatcgcttgaacccaggaggcggaggttgcggtctggagtgggactgactggctccagacagaccatgttctacacagaggtgacagatgcccagcgtagcggtccaggtgggggcctggtggaggagggtgagctcattgaggtggtgcacctgcccctggaaggcgcccaggcctttgcagacgacccggacatccccaagaccctcggcgtcatctttggtgtctcatggttcctcagccaggtggcccccaacctggatctccagtga

SEQ ID NO: 804 - DNA, 745 bp, Artificial Sequence
  Synthetic polynucleotide
ggtatggtggctcacacctgtatttccagctgctcaggagaccgaggctgaagcacgaagatcgcttgagctcaggcattaaagaccagcctgggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttga

SEQ ID NO: 805 - DNA, 745 bp, Artificial Sequence; identical to SEQ ID NO: 804
  Synthetic polynucleotide

SEQ ID NO: 806 - DNA, 1392 bp, Artificial Sequence
  Synthetic polynucleotide
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 807 - DNA, 1191 bp, Artificial Sequence
  Synthetic polynucleotide
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtag

SEQ ID NO: 808 - DNA, 1392 bp, Artificial Sequence; identical to SEQ ID NO: 806
  Synthetic polynucleotide

SEQ ID NO: 809 - DNA, 412 bp, Artificial Sequence
  Synthetic polynucleotide
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagcca

SEQ ID NO: 810 - DNA, 366 bp, Artificial Sequence
  Synthetic polynucleotide
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaat

SEQ ID NO: 811 - DNA, 297 bp, Artificial Sequence
  Synthetic polynucleotide
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagc

SEQ ID NO: 812 - DNA, 161 bp, Artificial Sequence
  Synthetic polynucleotide
ggccaggtgtggtggcttgtgcgtgtaatcccagaactttgggaggccaaggcaggtggattacctgagccaggactaaaagaagtggtagaatcctgtcgaggaaaaaatctttttttttctaccaatattgatgatgccatcaaagaagctgatcttgt

SEQ ID NO: 813 - DNA, 460 bp, Artificial Sequence
  Synthetic polynucleotide
catttgatctccgggagccctggctccctcgcttggaacaggagccacagctgccgcgtgggatgatgatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctga

SEQ ID NO: 814 - DNA, 460 bp, Artificial Sequence; identical to SEQ ID NO: 813
  Synthetic polynucleotide

SEQ ID NO: 815 - DNA, 460 bp, Artificial Sequence; identical to SEQ ID NO: 813
  Synthetic polynucleotide

SEQ ID NO: 816 - DNA, 460 bp, Artificial Sequence; identical to SEQ ID NO: 813
  Synthetic polynucleotide

SEQ ID NO: 817 - DNA, 636 bp, Artificial Sequence
  Synthetic polynucleotide
ggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctga

SEQ ID NO: 818 - DNA, 636 bp, Artificial Sequence; identical to SEQ ID NO: 817
  Synthetic polynucleotide

SEQ ID NO: 819 - DNA, 582 bp, Artificial Sequence
  Synthetic polynucleotide
ggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcgatgtctggcgataaagggatttctgccttccctgaatcagacaaccttttcaaatgggtagggaccatccatggagcagctggaacagcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctga

SEQ ID NO: 820 - DNA, 636 bp, Artificial Sequence; identical to SEQ ID NO: 817
  Synthetic polynucleotide

SEQ ID NO: 821 - DNA, 718 bp, Artificial Sequence
  Synthetic polynucleotide
gcgcgacgcagcggcgcggcgcgtggcgtaaggggcgtggcgccagtgggcgtggcgtggcgcagtgcgaagggacgcggcccagacatgtccgtccttgtaagttaaaagcttccatgggagccttccttcctaatcaagattggatcacctcccaccctgaggctccccaagactttgaacagttcttcagtgatccttacagaaagacaccctctccaaacaaacgcagcatttatatacagtccattggctctctaggaaacaccagaattatcagtgaagaatatattaaatggctcacgggctactgtaaagcatatttctatggcttgagagtaaaactcctagaaccagttcctgtttctgtaacaagatgttcctttagagtcaatgagaacacacacaacctacaaattcatgcaggggacatcctgaagttcttgaaaaagaagaaacctgaagatgccttctgtgttgtgggaataacaatgattgatctttacccaagagactcgtggaattttgtctttggacaggcctctttgacagatggtgtggggatattcagctttgccaggtatggcagtgatttttatagcatgcactataaaggcaaagtgaagaagctcaagaaaacatcttcaagtgactattcaattttcgacaactattatattccagaaataactagtgttttactacttcgatcctgtaa

SEQ ID NO: 822 - DNA, 1913 bp, Artificial Sequence
  Synthetic polynucleotide
ccttttccccagtagtttcactccaggaatccctcagataactcccacatgtggaaaaacgtctgtttcaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactag

SEQ ID NO: 823 - DNA, 1913 bp, Artificial Sequence; identical to SEQ ID NO: 822
  Synthetic polynucleotide

SEQ ID NO: 824 - DNA, 1874 bp, Artificial Sequence
  Synthetic polynucleotide
ccttttccccagtagtttcactccaggaatccctcagataactcccacatgtggaaaaacgtctgtttcaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagtccgtaattgagcaggtctcgtgggatacctga

SEQ ID NO: 825 - DNA, 1874 bp, Artificial Sequence; identical to SEQ ID NO: 824
  Synthetic polynucleotide

SEQ ID NO: 826 - DNA, 1913 bp, Artificial Sequence; identical to SEQ ID NO: 822
  Synthetic polynucleotide

SEQ ID NO: 827 - DNA, 362 bp, Artificial Sequence
  Synthetic polynucleotide
ggccgggcacggtggctcacacctgtaattctaacactttgggaggccgaggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctag

SEQ ID NO: 828 - DNA, 1583 bp, Artificial Sequence
  Synthetic polynucleotide
atgcagctgaagttgcctcagggctaccagcccggtggagggttgggagaattttgcagaaacctctttgctcctctggtaggcatttgaaaatgtggcttgggtcaggaacaggcgcccccacccgccgggtcccaggtgttcttcgattttcctttgcattgatggataggtcactcattccccctttgcaccggcacatgcctggacaccaccgtttctttcgccgtcgccccgtatgcctccggtgatacacgttcacaccatctgctgtgggatacgccagtgcctcgcatgttcccgtggtctccacctcgcattcgcccctgttcctgtttgcacgagtcctgtaaagcgcggtcggctttcctgagccccagggcttttagaagcggggtatgccactgctctttcaaaggaggagggaggcagagggttgaatgatcagtgaatttgcagccgacactttgcctcgagacctgtgggatcattctttgctgcatggaggccctgcctgccccagcagatgtggcgagcccatcctatgtcactcggtgggggcctaaatcggatctgaaggggtgtcctgagaacacagcaggcgtcctgaagctccctctccctccctccgtggaagtcagctcaaggagttcctgaggacaggattcctgggggtttggtcctgggacaggacaagacacccacggtcccgtctcccacgccgccacaaactggagcccggatccaggccgcggctgcagcgggaacctcgctgccctgcgctgcagtagcgttatttaaaggggatgcagcctgactgccagaagcggagcgctagtcaggccagccaatgcgcatgcgcgcggcgcgagcgacttctcctgtcacagtggttcccacggttgtcttagaaaccagtccctgaggcttggcaaagcaggagccctccgtggcagtgcttgtgtgtcggggctctgaggctccggcctgacctctccacagggtcgacgggaacgtctctggatgccaggagacgcaaagggccgaccagaatgaggaattcccaggcggagtccaggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 829 - DNA, 1421 bp, Artificial Sequence
  Synthetic polynucleotide
atgcagctgaagttgcctcagggctaccagcccggtggagggttgggagaattttgcagaaacctctttgctcctctggtaggcatttgaaaatgtggcttgggtcaggaacaggcgcccccacccgccgggtcccaggtgttcttcgattttcctttgcattgatggataggtcactcattccccctttgcaccggcacatgcctggacaccaccgtttctttcgccgtcgccccgtatgcctccggtgatacacgttcacaccatctgctgtgggatacgccagtgcctcgcatgttcccgtggtctccacctcgcattcgcccctgttcctgtttgcacgagtcctgtaaagcgcggtcggctttcctgagccccagggcttttagaagcggggtatgccactgctctttcaaaggaggagggaggcagagggttgaatgatcagtgaatttgcagccgacactttgcctcgagacctgtgggatcattctttgctgcatggaggccctgcctgccccagcagatgtggcgagcccatcctatgtcactcggtgggggcctaaatcggatctgaaggggtgtcctgagaacacagcaggcgtcctgaagctccctctccctccctccgtggaagtcagctcaaggagttcctgaggacaggattcctgggggtttggtcctgggacaggacaagacacccacggtcccgtctcccacgccgccacaaactggagcccggatccaggccgcggctgcagcgggaacctcgctgccctgcgctgcagtagcgttatttaaaggggatgcagcctgactgccagaagcggagcgctagtcaggccagccaatgcgcatgcgcgcggcgcgagcgacttctcctgtcacagtggttcccacggttgtcttagaaaccagtccctgaggcttggcaaagcaggagccctccgtggcagtgcttgtgtgtcggggctctgaggctccggcctgacctctccacagggtcgacgggaacgtctctggatgccaggagacgcaaagggccgaccagaatgaggaattcccaggcggagtccaggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 830 - DNA, 136 bp, Artificial Sequence
  Synthetic polynucleotide
ttggtcgctgtggcacccactgaataaaaggagactcagtggcagtggatctgggacagatttcactctcaccatcagcagcctgcagcctgaagattttgcaacttattactgtcaacagtttaataattaccct

SEQ ID NO: 831 - DNA, 164 bp, Artificial Sequence
  Synthetic polynucleotide
tttttaaaattaataataattagcaaagcatggtagctcacacgtttactcccagctactcaggaggcagaggagccgggaggatcacttgagcccaggagttcaaggctgtggagggcatcctggctgtttcacccgtggacttgaacttgccattggactga

SEQ ID NO: 832 - DNA, 164 bp, Artificial Sequence; identical to SEQ ID NO: 831
  Synthetic polynucleotide

SEQ ID NO: 833 - DNA, 164 bp, Artificial Sequence; identical to SEQ ID NO: 831
  Synthetic polynucleotide

SEQ ID NO: 834 - DNA, 193 bp, Artificial Sequence
  Synthetic polynucleotide
tttttaaaattaataataattagcaaagcatggtagctcacacgtttactcccagctactcaggaggcagaggagccgggaggatcacttgagcccaggagttcaaggctgtggagggcatcctggctgtttcacccgtggacttgaacttgccattggactgagctctttctcagaagctgctacaagatga

SEQ ID NO: 835 - DNA, 915 bp, Artificial Sequence
  Synthetic polynucleotide
gttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaa

SEQ ID NO: 836 - DNA, 735 bp, Artificial Sequence
  Synthetic polynucleotide
gttttctcttgtctccaggcctttgcacaggctttttcttcaacttggagtatttccctgcttctatccgtcccaactcccctgccaaactgttctctttcggttattgatttaaatgtcacttcttccgggaagccttcccacgcttcctctggctagattgtttgctttttcttaggttgttgggtttttcgtttatgtcactctctcattctgtgtttaaattgccagcttttttgttctgaactcccactgcgttgtggattcctgaggatgggatgactgtatcttgattacccggaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtaa

SEQ ID NO: 837 - DNA, 451 bp, Artificial Sequence
  Synthetic polynucleotide
ttcctagtgtgcgggtccccaagcctgggagttgtccttgataccttggtacagtctcatccctacagccaatcataagtggattagattgtctctgccttctgaacacacctgaattcatccatggcttcatgccctgttgcaggcagattttttgaaaggactgcctgtctacaacaaaagcaattttagtcgatttcacgcggactccgtgtgcaaagcctcgaaccgacggccctcagtctacctgcctacccgcgagtacccgtctgaacagatcatcgtgacagaaaagacaaacatcctcctgcgctacctgcatcagcaatgggacaaaaagaacgctgccaagaagagagaccaggagcaagtggagctggaaggcgagagctccgcacctccccgcaaggtggcgcggaccgacagcccagacatgcacgaggacacttaa

SEQ ID NO: 838 - DNA, 451 bp, Artificial Sequence; identical to SEQ ID NO: 837
  Synthetic polynucleotide

SEQ ID NO: 839 - DNA, 451 bp, Artificial Sequence; identical to SEQ ID NO: 837
  Synthetic polynucleotide

SEQ ID NO: 840 - DNA, 546 bp, Artificial Sequence
  Synthetic polynucleotide
aaaatatatacccagaatgttatcaattcttaccacctgcagtattatcaccctcagccaaactaacatcctctcttgtattatttttatattgcctcttagctgatttccctgcctataaccgaccccctacaccggtctgctctcagcacaacagccagagatatcctggttctggggctgctggtatggacgcttattgctggaactgagtacttccgggtccccgcatttggctgggtcatgtttgtagctgtattttactgggtcctcaccgtcttcttcctcattatctacataacaatgacctacaccaggattccccaggtgccctggacaacagtgggcctgtgctttaacggcagtgccttcgtcttgtacctctctgccgctgttgtagatgcatcttccgtctcccctgagagggacagtcacaacttcaacagctgggcggcctcatcgttctttgccttcctggtcaccatctgctacgctggaaatacatatttcagttttatagcatggagatccaggaccatacagtga

SEQ ID NO: 841 - DNA, 818 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaa

SEQ ID NO: 842 - DNA, 881 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagggtagtgatttgatctccaggagcaaaatatggcacccagaaagtagcccccaaagagaaggctacccccatgatagtctgccgtgcttggctttcgattacttttctctactgccgccccagtgtaaagaaatggtttaa

SEQ ID NO: 843 - DNA, 818 bp, Artificial Sequence; identical to SEQ ID NO: 841
  Synthetic polynucleotide

SEQ ID NO: 844 - DNA, 738 bp, Artificial Sequence
  Synthetic polynucleotide
ctctccctctcctccctctccctctccctctccctctccccacggtctccctctccctctctttccatggtctccctctgatgccgagccgaagctggactgtactgctgccatctcggctcactgcaacctccctgcctgattctcctgcctcagcctgctgactgcctgcgattgcaggcacgcgccgccacgcctgactggttttcatatttttttggtggagacggggtttcgctgtgttggcggggctggtctccagctcctaaccgcgagtgatctgccagcctcggcctcctgaggtgccgggattgcagacggagtctcgttcactcagtgctcaatggtgcccaggctggagtgcagtggcgtgatctcagctcgctacaacctccacctcccagccgcccgccttggcctcccaaagtgccgagattgcagcctctgcctggccgccaccccgtctgggaagtgaggagcgtctctgcccggccgcccattgtctgagatgtggggagcgcctctgccccgcaaccccgtctgggaggtgaggagcgtctctgcccggccgccccgtctgagaacgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagaccc

SEQ ID NO: 845 - DNA, 1557 bp, Artificial Sequence
  Synthetic polynucleotide
atagctttgatatttttccccttcaaagctcatgttgaaatttgatttccaaattggagatggggcctagtgagaggtatttgggttataggggtggatcactcatgaatggcttggagccctccgtgtggtactgagtaagttcttgctctattagtttatgtgagagttgactgttttagaaagcctggcacctccacccatctctcttcctccctctctcaccatgtgacacatctgcccccacttcaccttctgccatgagtaaaagcttcctgaggctctcaccagaagtagatgatagtgctatgcttcttgtacagcctgcagaactgtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 846 - DNA, 1449 bp, Artificial Sequence
  Synthetic polynucleotide
atagctttgatatttttccccttcaaagctcatgttgaaatttgatttccaaattggagatggggcctagtgagaggtatttgggttataggggtggatcactcatgaatggcttggagccctccgtgtggtactgagtaagttcttgctctattagtttatgtgagagttgactgttttagaaagcctggcacctccacccatctctcttcctccctctctcaccatgtgacacatctgcccccacttcaccttctgccatgagtaaaagcttcctgaggctctcaccagaagtagatgatagtgctatgcttcttgtacagcctgcagaactgtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcatag

SEQ ID NO: 847 - DNA, 789 bp, Artificial Sequence
  Synthetic polynucleotide
atagctttgatatttttccccttcaaagctcatgttgaaatttgatttccaaattggagatggggcctagtgagaggtatttgggttataggggtggatcactcatgaatggcttggagccctccgtgtggtactgagtaagttcttgctctattagtttatgtgagagttgactgttttagaaagcctggcacctccacccatctctcttcctccctctctcaccatgtgacacatctgcccccacttcaccttctgccatgagtaaaagcttcctgaggctctcaccagaagtagatgatagtgctatgcttcttgtacagcctgcagaactgtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctc

SEQ ID NO: 848 - DNA, 904 bp, Artificial Sequence
  Synthetic polynucleotide
agaaagggatgtggtataatgggaagagctttggctttacagtctggctaatatttccagtgaaatctcagactctccagtttactggggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattag

SEQ ID NO: 849 - DNA, 430 bp, Artificial Sequence
  Synthetic polynucleotide
agaaagggatgtggtataatgggaagagctttggctttacagtctggctaatatttccagtgaaatctcagactctccagtttactggggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcgagatcggagttctttaattag

SEQ ID NO: 850 - DNA, 904 bp, Artificial Sequence; identical to SEQ ID NO: 848
  Synthetic polynucleotide

SEQ ID NO: 851 - DNA, 1595 bp, Artificial Sequence
  Synthetic polynucleotide
tgcagccgaatttgcctcagggctaccagcgcggtggagggttgggggtggggagaattttgcagaaacctctttgctcctctggtaggcatttgaaaacgtggcttgggtcaggcacaggcgcccccacccgccgggtcccaggtggtcttcgattttcctttgcattgatggataggtcactcgttccccccttgcaccggcacatgcctggacaccaccgtttctttcgctgtcgcccggtttgcctccggtgacacacgttcacaccatctgctgtgggatacgccagtgccattcgtgttcacatggtctccacctcgcaatctcccctgttcttgtttgcacgagtcctgtaaagcgcggtcggctttcctgagccccagggcttttagaagaggggtaggccactgctctttcaaaggaggagggaggcagagggttgaaggatcagtgaatttgcagcggacacttggcctcgagacctatgggatcattcttggctgcagcgaggccctgcctgcctcagcgcatgtggcgagcccatcctatctcactcagtgggggccgaaatgggatctgaaggggtgtcctgagaacacagcaggcgtcctgaagctccccctccctccctcggtggaagtcagctcaaggagttcctgaggacaggactcctgggggtttggccctgggacaggacaagacacccacggtccggtctcccaagccgccacaaactggagcccggatccagccgccgccgcggctgcagcaggaggctcgctgccgccgcgctgcggtggcgttatttaaaggggacgcagcctgaccgccaggagcggagcgccagtcgggcgggccaatgcgcatgcgcgaggcgcgagcctcttctcccgtcacagtggttcccacggttgtcttagaaaccagtccccgaggcttggcaaagcaggagcccttcgtggcagtgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 852 - DNA, 1433 bp, Artificial Sequence
  Synthetic polynucleotide
tgcagccgaatttgcctcagggctaccagcgcggtggagggttgggggtggggagaattttgcagaaacctctttgctcctctggtaggcatttgaaaacgtggcttgggtcaggcacaggcgcccccacccgccgggtcccaggtggtcttcgattttcctttgcattgatggataggtcactcgttccccccttgcaccggcacatgcctggacaccaccgtttctttcgctgtcgcccggtttgcctccggtgacacacgttcacaccatctgctgtgggatacgccagtgccattcgtgttcacatggtctccacctcgcaatctcccctgttcttgtttgcacgagtcctgtaaagcgcggtcggctttcctgagccccagggcttttagaagaggggtaggccactgctctttcaaaggaggagggaggcagagggttgaaggatcagtgaatttgcagcggacacttggcctcgagacctatgggatcattcttggctgcagcgaggccctgcctgcctcagcgcatgtggcgagcccatcctatctcactcagtgggggccgaaatgggatctgaaggggtgtcctgagaacacagcaggcgtcctgaagctccccctccctccctcggtggaagtcagctcaaggagttcctgaggacaggactcctgggggtttggccctgggacaggacaagacacccacggtccggtctcccaagccgccacaaactggagcccggatccagccgccgccgcggctgcagcaggaggctcgctgccgccgcgctgcggtggcgttatttaaaggggacgcagcctgaccgccaggagcggagcgccagtcgggcgggccaatgcgcatgcgcgaggcgcgagcctcttctcccgtcacagtggttcccacggttgtcttagaaaccagtccccgaggcttggcaaagcaggagcccttcgtggcagtgcttgtgtgtcggagctctgaggctccggcctgacctctcctcggggtcgacgggaacgtctccggatgccaggactcgcaaagggctgacaagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 853 - DNA, 649 bp, Artificial Sequence
  Synthetic polynucleotide
cagggctgatgcctgtgtttgtgtgtgttgttcactgctctatggtgcctgggccagggggaatgagatcatcaatgctgtggtactgttgattttattgagtgccctggctgatccggatcagtataacttttcaagttctgaactgggaggtgactttgagttcatggatgatgccaacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctaccgatacatcaatggtaggaactcctctgatgtcctggtttatgttaccagcaatgacactacggtgctgctacccccgtatgatgatgccactgtgaatggtgctgccaaggagccaccgccaccttacgtgtctgcctaa

SEQ ID NO: 854 - DNA, 649 bp, Artificial Sequence; identical to SEQ ID NO: 853
  Synthetic polynucleotide

SEQ ID NO: 855 - DNA, 425 bp, Artificial Sequence
  Synthetic polynucleotide
cagggctgatgcctgtgtttgtgtgtgttgttcactgctctatggtgcctgggccagggggaatgagatcatcaatgctgtggtactgttgattttattgagtgccctggctgatccggatcagtataacttttcaagttctgaactgggaggtgactttgagttcatggatgatgccaaaattctttttaatctttcggcagacatgtgcattgccattgcgatttctcttctcatgatcctgatatgtgctatggctacttacggagcgtacaagcaacgcgcagcctggatcatcccattcttctgttaccagatctttgactttgccctgaacatgttggttgcaatcactgtgcttatttatccaaactccattcaggaatacatacggcaactgcctcctaattttccctacagagatg

SEQ ID NO: 856 - DNA, 233 bp, Artificial Sequence
  Synthetic polynucleotide
cctgtaattccagcattttgggaggctgaggtgggaggattgcttgagttcaagagttcaagaccagtctgggcaacatggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtga

SEQ ID NO: 857 - DNA, 233 bp, Artificial Sequence; identical to SEQ ID NO: 856
  Synthetic polynucleotide

SEQ ID NO: 858 - DNA, 233 bp, Artificial Sequence; identical to SEQ ID NO: 856
  Synthetic polynucleotide

SEQ ID NO: 859 - DNA, 233 bp, Artificial Sequence; identical to SEQ ID NO: 856
  Synthetic polynucleotide

SEQ ID NO: 860 - DNA, 375 bp, Artificial Sequence
  Synthetic polynucleotide
ggccgagcgcggtggctcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtag

SEQ ID NO: 861 - DNA, 375 bp, Artificial Sequence; identical to SEQ ID NO: 860
  Synthetic polynucleotide

SEQ ID NO: 862 - DNA, 255 bp, Artificial Sequence
  Synthetic polynucleotide
ggccgagcgcggtggctcaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgatagtgcctcccctccctgttccccaccaggcactgcaacatggtgctggagaacgtga

SEQ ID NO: 863 - DNA, 1389 bp, Artificial Sequence
  Synthetic polynucleotide
cccgtgggatttttaatagatatctcaagcttagcacacccagggctcacctcctgcctcttcctctccaaacctgctcttcctatagtatttccagcagcagatctgtccttccagatgtttaggccagaaatcttgggctcttttttgagcccctgttttctctaacatctcagatatgacttgttagcaaatcttgtagcctgtacttcagagtctactgtgaatcctatcctttctcaccatgtctgctgcatgctggtccaggcagtagtctcactcctagctcatttaggtgactttataactagtttctctgcttgtttgttccccttcaggctcttctcaacacaggagtcagagtggggtgatcctgctccaacagaggaaatcagggatcctcttatgcagtggcttgggaaacatgtggactccgagggagaaataaaatccggccagctctctcttagatttgtttcatcctacgtgtctgaagtagaaataaccccatcttgtatacctgtggtgaccaacatggaggccttctcatcagaacatttcaacttagagatctatcgccaaaatctgcagaccaagcagttggggaaagtaattttgtttgccgaagtgacccccacaacgatgcgtctcctggatgggctgatgtttcagacaccgcaggaaatgggcttaatagtgatcgcggcccggcagaccgagggcaaaggacggggagggaatgtgtggctgagccctgtgggatgtgctctttctactctgctcatctccattccactgagatcccagctgggacagaggatcccgtttgtccagcatctgatgtccgtggctgtcgtggaagcagtgaggtccattcccgagtatcaggatatcaacttacgagtgaagtggcccaacgatatttattacagtgacctcatgaagatcggcggagttctggttaactcaacactcatgggagaaacattttatatacttattggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacagtggtcagcaagtccatctgggcagcgcagagggaccaaaggtgtccatcgttggcctggacgattctggcttcctccaggttcaccaggagggcggcgaggttgtgactgtgcacccggacggcaactccttcgacatgctgagaaacctcatcctccccaaacggcggtaa

SEQ ID NO: 864 - DNA, 1389 bp, Artificial Sequence; identical to SEQ ID NO: 863
  Synthetic polynucleotide

SEQ ID NO: 865 - DNA, 2094 bp, Artificial Sequence
  Synthetic polynucleotide
tgacatggtttagctgggtctgcacccaaatctcaactttaattgtatctcccagaattcccatgtgttgtgggagggacccagggggaggtaattgaatcacgggggccggtctttcccgtgttattctcgtgatagtgaataggtctcatgagatctgacgggtttgtctggggtttccgcttttgcttcttcctcattttctcttgcgctgccatgtaagaactgcctttcacctcccacaatgattctgaggcctccccagacatgtggaattaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagaccctagctaacatattatggagagaagaaggtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 866 - DNA, 2094 bp, Artificial Sequence; identical to SEQ ID NO: 865
  Synthetic polynucleotide

SEQ ID NO: 867 - DNA, 2094 bp, Artificial Sequence; identical to SEQ ID NO: 865
  Synthetic polynucleotide

SEQ ID NO: 868 - DNA, 2067 bp, Artificial Sequence
  Synthetic polynucleotide
tgacatggtttagctgggtctgcacccaaatctcaactttaattgtatctcccagaattcccatgtgttgtgggagggacccagggggaggtaattgaatcacgggggccggtctttcccgtgttattctcgtgatagtgaataggtctcatgagatctgacgggtttgtctggggtttccgcttttgcttcttcctcattttctcttgcgctgccatgtaagaactgcctttcacctcccacaatgattctgaggcctccccagacatgtggaattaagtgatccagttgagtctgccagaagatcagaaactaagcatcactgcagcaactgtgggacaaagtgctgttctgagctgtgccattcaaggaaccctgagacctcccattatctggaaaaggaacaatattattctaaataatttagatttggaagacatcaatgactttggagatgatgggtccttgtatattactaaggttaccacaactcacgttggcaattacacctgctatgcagatggctatgaacaagtctatcagactcacatcttccaagtgaatgttcctccagtcatccgggtgtatccagagagtcaggctagagagcctggggtaactgccagtcttaggtgccatgcagagggcataccaaagcctcagcttggctggttgaagaatggaattgatattacaccaaagctttccaaacaactcacgcttcaagcaaatggcagtgaggttcacataagcaatgtgcgctatgaagatactggagcatacacttgtatcgcaaagaatgaagcaggagtggatgaagacatctcttctctttttgtggaagactctgctagaaagacccgtctgggaattgggaacatgttctatgttttttatgaagatggaatcaaagtgatacaacccatagaatgtgaatttcagaggcacattaagcctagtgaaaagctccttggatttcaggatgaagtctgtcccaaagctgagggagatgaagttcagaggtgtgtgtgggcatcagctgttaatgtcaaagacaagttcatttatgttgcacagccaactttggacagagtccttattgttgatgtgcagtcccaaaaagttgttcaggcagtgagcacagaccctgtcccagttaaattacactatgacaaatcacatgatcaggtctgggtgctaagctggggtaccttggagaagacatcaccaacactacaggtaattaccctggccagtgggaatgtgcctcaccacacgatccacacccaaccagtgggaaagcaatttgacagagtggatgattttttcattcccaccacaacactcattatcacccatatgaggtttggatttattcttcataaagatgaagctgcactacaaaaaattgatcttgaaaccatgtcatacatcaagacaattaacttgaaggactataagtgcgttcctcagtcattggcatatacacacttgggaggctactacttcattggctgcaaacctgacagcaccggagcagtttccccacaggtcatggtggacggtgtaactgactcagtcattgggttcaatagtgatgtgacgggcactccatatgtctctccagatggccactaccttgtcagcattaatgatgtgaaaggtcttgtaagggttcagtacattaccatcagaggagaaatacaggaggcttttgatatttacacaaatctgcacatatctgatctggcatttcaaccatcctttactgaagcccaccaatataacatctacggtagttcaagcacacaaactgatgtgctctttgtggagctctcttctgggaaggtcaagatgataaagagtctcaaggaaccactcaaggcagaagaatggccttggaaccggaaaaacaggcaaatccaggacagtggcttgtttggtcaatacctgatgacaccttccaaggactctctcttcatcctagatggacgactcaataaattaaactgtgagatcactgaagttgaaaaaggaaatacagtcatttgggttggagatgcctaa

SEQ ID NO: 869 - DNA, 566 bp, Artificial Sequence
  Synthetic polynucleotide
gcttagtgcacaccctggcatatggtaaatactacatagccacgatggccctgatcacagcctccactgcgttgaccatcatggtgatgaatatccacttctgtggggccgaggcccggccggtgccacactgggccagggtggtcatcctgaaatacatgtccagggtcttgtttgtctatgatgtgggtgaaagctgcctcagcccgcaccacagtagagagcgggaccacctcacgaaagtttatagcaaactcccagagtctaacctgaaagcagccaggaacaaagacctttccagaaagaaggacatgaacaaacgcttaaagaacgacctgggctgccagggtaagaaccctcaggaggccgagagttactgtgcacagtacaaagtgctgacgaggaatattgagtacatcgccaagtgcctcaaagaccacaaggccaccaattccaaggggagtgaatggaagaaggtggcgaaagtcatagaccgattcttcatgtggatttttttcattatggtgtttgtgatgactattttgatcatagcaagagcggattag

SEQ ID NO: 870 - DNA, 1593 bp, Artificial Sequence
  Synthetic polynucleotide
tggtgcaggggaggttgtgtgagggctacctgggcggtggagctttggccttggggtgaattttgcagaaacctatttgttgctctggcaggaatttcaaattttggatccggtcagtcacaagccgcctcctgtttcccaagtgttctttaatttttcattgctgtgatggaaatgtcacttgaccctcccttccaccgggcacatgcctagacagcatcgtttgtttcgccgtcgccccacattcctctggttacacacattcaagccatctgctgtgggattggtcagtgccacacgtcaacgcatggtctccacctgggattcgcccctgttcctgtttgcacgtgtcctgtaaattgcgattggcttccagagccccagggcttttagaagcccggcaggccagtgttctttaaaaggagaagggaggcagagggctgatggatcagtgaaatttcagctgacagcatgccttgagacccatgggatcattgtgtgctgcagcgaggccctgcctgcctcaccagatgtggtgagcccatcctatctcactcggtgggggccaaaatcagatctgaaggggagtcctgagaacacagcaggcgtcctgaagctccccctccctccctcggtggaagtcggctcaaggagtttctgaggacaggactcctgggggtttggccgtgggacagaagaagacacccgcggtcccctctcccacgccgacccaaactggagcccggatccagccgccgccgcggctgcagcaggagcctccctgccgccgcgctgcggtggcgttatttaaaggggacgcagcctgaccgccaggagcggagcgccagtcgggtgggccaatgcgcatgcgcgaggcgcgagcgccttctcccgtcacagtggttcccacggttgtcttagaaaccagtccccgaggcttggcaaagcaggagcgctccgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctggctggctggagccacttgtgcggcgcagccctggcggaggttcaggcggccccggtgtcgcaagcggctgtgagtgatgcctccctggggccggagtggtcccaggaaggctgcagaccagggctgaccagcgggcagcatggtggccgcgatggaaggtga

SEQ ID NO: 871 - DNA, 1431 bp, Artificial Sequence
  Synthetic polynucleotide
tggtgcaggggaggttgtgtgagggctacctgggcggtggagctttggccttggggtgaattttgcagaaacctatttgttgctctggcaggaatttcaaattttggatccggtcagtcacaagccgcctcctgtttcccaagtgttctttaatttttcattgctgtgatggaaatgtcacttgaccctcccttccaccgggcacatgcctagacagcatcgtttgtttcgccgtcgccccacattcctctggttacacacattcaagccatctgctgtgggattggtcagtgccacacgtcaacgcatggtctccacctgggattcgcccctgttcctgtttgcacgtgtcctgtaaattgcgattggcttccagagccccagggcttttagaagcccggcaggccagtgttctttaaaaggagaagggaggcagagggctgatggatcagtgaaatttcagctgacagcatgccttgagacccatgggatcattgtgtgctgcagcgaggccctgcctgcctcaccagatgtggtgagcccatcctatctcactcggtgggggccaaaatcagatctgaaggggagtcctgagaacacagcaggcgtcctgaagctccccctccctccctcggtggaagtcggctcaaggagtttctgaggacaggactcctgggggtttggccgtgggacagaagaagacacccgcggtcccctctcccacgccgacccaaactggagcccggatccagccgccgccgcggctgcagcaggagcctccctgccgccgcgctgcggtggcgttatttaaaggggacgcagcctgaccgccaggagcggagcgccagtcgggtgggccaatgcgcatgcgcgaggcgcgagcgccttctcccgtcacagtggttcccacggttgtcttagaaaccagtccccgaggcttggcaaagcaggagcgctccgtggcagtgcttgtgtgtcggggctctgaggctccggcctgacctctcctcggggtcgacgggaaggtctccggatgccaggactcgcaaagggccgaccagaatgaggaaatcccaggcggagtccgggggaggcagcacggcatcccagcctcagggctgcccggacggtgttggttgggaaatggtgcgagaactttggatgtggaacgtggaggaggaggaacacgaagtggggatctgcacttggggtggtcagcactgcggatgcccagcaaagtcactgcctggtccacatcccggaggggtctctgcgcctcagtcggcatcgcagctgatggtgaaacttttggtgtggcagaagagtgtccacaaacttcggaaggtatccgctacatcctccatagccgtgtatccctgcccagggcaatcttctgggggagcggaaagtcctgctcccgggccagggctg

SEQ ID NO: 872 - DNA, 1002 bp, Artificial Sequence
  Synthetic polynucleotide
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtag

SEQ ID NO: 873 - DNA, 897 bp, Artificial Sequence
  Synthetic polynucleotide
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgat

SEQ ID NO: 874 - DNA, 836 bp, Artificial Sequence
  Synthetic polynucleotide
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgc

SEQ ID NO: 875 - DNA, 528 bp, Artificial Sequence
  Synthetic polynucleotide
tgatatggtttggctgtgtgtctccacccaagtctcatcttgtagctcccataattcccaagtgttgtgggaggaacccggtgggagatgattgaatcatgggggcgggtctttcccgtgctgttctggtgatactgaatgggtctcacgagatctgatggtttcgaaaacaggagtttctctgcacaagctctctgtttgcctgctgtcgtccacataagatgtgacttgctcctgcttgccttcctccatgattgtgaggcctccccagccacgtggaactttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaacc

SEQ ID NO: 876 - DNA, 549 bp, Artificial Sequence
  Synthetic polynucleotide
cttaggtgccatagtcagccaaaagcagtgtgtgggccttgtgttgaatctcccttcaaacagaccaactgttggaggacattttagagacagagaaaactgaacacaggtgttggatgatgataaggaagtctcgttgattctgttaggaaagaaatgctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaa

SEQ ID NO: 877 - DNA, 549 bp, Artificial Sequence; identical to SEQ ID NO: 876
  Synthetic polynucleotide

SEQ ID NO: 878 - DNA, 549 bp, Artificial Sequence; identical to SEQ ID NO: 876
  Synthetic polynucleotide

SEQ ID NO: 879 - DNA, 1795 bp, Artificial Sequence
  Synthetic polynucleotide
ctctccctctccctcctcgccctctccctctccctctccccacggtctccctctccctctctttccatggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgttggccgggctggtctccagctcctaaacgcgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggatgtgaggagcccctctgcctggctgcccagtctggaaagtgaggagcgtctctgaccggccgccatcccatctaggaagtgaggagagcctcttcccggccgccatcccatctaggaagtgaggagcgtctctgcccggccacccatcgtctgagatgtggggagcgcctctgctccaccgccccgtctgggatgtgaggaccgcctctgcccggccgcgaccccgtctgggaggtgaggagcgtctctgcctggccgccccgtctgagaagtgaggagaccctccgcccggcagccgcccagtctgagaagtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccaccccgtccaccacccccggtgcgcccagtcccccagggaacaccccctgtggttgaagagcagccgcagccaccattagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccagctttccaggccagccccagccctcagtgcccctgcagcccccttatccccccgggcccgcccctccctatgggttcccaccaccgccggggcctgcctggcctgggtattag

SEQ ID NO: 880 - DNA, 1171 bp, Artificial Sequence
  Synthetic polynucleotide
ctctccctctccctcctcgccctctccctctccctctccccacggtctccctctccctctctttccatggtctccctctgatgccgagccgaagctggactgtactgctgccatctcggctcactgcaacctccctgcctgattctcctgcctcagcctgccgagtgcctgcgattgcaggcgcgcgccgccacgcctgactggttttcgtatttttttggtggagacggggtttcactgtgttggccgggctggtctccagctcctaaacgcgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcatctctgcctggccgcccatcgtctgggatgtgaggagcccctctgcctggctgcccagtctggaaagtgaggagcgtctctgaccggccgccatcccatctaggaagtgaggagagcctcttcccggccgccatcccatctaggaagtgaggagcgtctctgcccggccacccatcgtctgagatgtggggagcgcctctgctccaccgccccgtctgggatgtgaggaccgcctctgcccggccgcgaccccgtctgggaggtgaggagcgtctctgcctggccgccccgtctgagaagtgaggagaccctccgcccggcagccgcccagtctgagaagtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggtt

SEQ ID NO: 881 - DNA, 507 bp, Artificial Sequence
  Synthetic polynucleotide
cagggagttagcagggggctcatggttaagagtgtgaactacggcttagacctacagggttccctgcccagctcctccacaaaccagctgtgcaaccctagacaagtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctga

SEQ ID NO: 882 - DNA, 507 bp, Artificial Sequence; identical to SEQ ID NO: 881
  Synthetic polynucleotide

SEQ ID NO: 883 - DNA, 507 bp, Artificial Sequence; identical to SEQ ID NO: 881
  Synthetic polynucleotide

SEQ ID NO: 884 - DNA, 507 bp, Artificial Sequence; identical to SEQ ID NO: 881
  Synthetic polynucleotide

SEQ ID NO: 885 - DNA, 507 bp, Artificial Sequence; identical to SEQ ID NO: 881
  Synthetic polynucleotide

SEQ ID NO: 886 - DNA, 507 bp, Artificial Sequence; identical to SEQ ID NO: 881
  Synthetic polynucleotide

SEQ ID NO: 887 - DNA, 507 bp, Artificial Sequence; identical to SEQ ID NO: 881
  Synthetic polynucleotide

SEQ ID NO: 888 - DNA, 507 bp, Artificial Sequence; identical to SEQ ID NO: 881
  Synthetic polynucleotide

SEQ ID NO: 889 - DNA, 507 bp, Artificial Sequence; identical to SEQ ID NO: 881
  Synthetic polynucleotide

SEQ ID NO: 890 - DNA, 507 bp, Artificial Sequence; identical to SEQ ID NO: 881
  Synthetic polynucleotide

SEQ ID NO: 891 - DNA, 343 bp, Artificial Sequence
  Synthetic polynucleotide
tgatatgttttgaatttgtgtccctacccaaatatcatgtcaaattgtcatccctaatgttggaggaggggcctggtgagaggtgattggatcacagggagggacttccccttgcttttctctcaataatgagttctcacaagatctggttcttcagaagtgtgtggcacctcccctactctctctttctccttctccggccatgcaagacatatctgcttctccttcaccttccactatgattacaaaccttggaaatcaagaaagttctggaatgatgaagctgttcatgccaagaccgaaagtgctggcccagtatgagtccattcagttcatgccgtga

SEQ ID NO: 892 - DNA, 343 bp, Artificial Sequence; identical to SEQ ID NO: 891
  Synthetic polynucleotide

SEQ ID NO: 893 - DNA, 838 bp, Artificial Sequence
  Synthetic polynucleotide
tgatatggtttggctgtgtccccacccaaatctcattttgaattgtactttccataatccccacatgttgtgggagggacctggtgggaagtaattgaatcatcggggtggtttcctccatgccattctcatgatagtgagtaagttctcacaagatctgagggttttataagaggcttttccctttgaacttggatctcattcttctccgtcctgccgccctgtgaagaaggatttgtttgcttccccttctgccatggttataagtttcctgaggcttcctcagccctgcagaactgtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatattcatgtgatctgcaagtatgcaaacatctttttatccagatgctgcaaattattgaataa

SEQ ID NO: 894 - DNA, 547 bp, Artificial Sequence
  Synthetic polynucleotide
tgatatggtttggctgtgtccccacccaaatctcattttgaattgtactttccataatccccacatgttgtgggagggacctggtgggaagtaattgaatcatcggggtggtttcctccatgccattctcatgatagtgagtaagttctcacaagatctgagggttttataagaggcttttccctttgaacttggatctcattcttctccgtcctgccgccctgtgaagaaggatttgtttgcttccccttctgccatggttataagtttcctgaggcttcctcagccctgcagaactgtctcagcattagagaggcagatctttgacttccttggtttccagtgggcgcctattcttggaaattttctacacataatagttgtcatattgggtttgtttgggaccattcagtacagacctcgatacataatggtggacaccgatctaatgacattcaatatctctgtacatcggtcatggtggagagaacatgggcctggttgtgtcagaagagtgctgcctccctcagcccatggcatgatggac

SEQ ID NO: 895 - DNA, 838 bp, Artificial Sequence; identical to SEQ ID NO: 893
  Synthetic polynucleotide

SEQ ID NO: 896 - DNA, 373 bp, Artificial Sequence
  Synthetic polynucleotide
tttttaaaagccatttctcttgatgtgcactgcctcagctgaccgtcctgggtgtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 897 - DNA, 394 bp, Artificial Sequence
  Synthetic polynucleotide
aaattagctaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatc

SEQ ID NO: 898 - DNA, 1194 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 899 - DNA, 1116 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaa

SEQ ID NO: 900 - DNA, 1194 bp, Artificial Sequence; identical to SEQ ID NO: 898
  Synthetic polynucleotide

SEQ ID NO: 901 - DNA, 824 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaa

SEQ ID NO: 902 - DNA, 642 bp, Artificial Sequence
  Synthetic polynucleotide
gatatggtttggttctgtgtccccaccgaaatatcatgtcaaattgtaattcccggtgttgaaggaggggcctagtgggaggagattgaatcatgagggctgactttccttttactcttctcataatagaattctcatgagatctggttgtttgaaagtgtgtagcacctccaccttctctctctctctccctctccctctcctgccagccaagtgaagacatgcttacttccccttcaccttccttcatgatggtaagtttcccgaggcctcccgtgccatgccttctgtacagcctgcagaactgttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggaggacatagggattttaacatggaagaagagccctaaacataactcctaa

SEQ ID NO: 903 - DNA, 473 bp, Artificial Sequence
  Synthetic polynucleotide
cccacatgcagccaacgggcaaaatgtggtttcccttatccaccagggtgagcccttcctgaaatgtttatcaagagtttctttttctctcttcagcagcttgttggtgtagtcacctctcattgtggatttttaatcaatttgatctaaacatggaaaagcaaattttactttccacagatgggcaggatgtagtgaaagtccagagaaggttctcaccaaatgtgtgcagctcggaagaaaaaggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactga

SEQ ID NO: 904 - DNA, 586 bp, Artificial Sequence
  Synthetic polynucleotide
cccacatgcagccaacgggcaaaatgtggtttcccttatccaccagggtgagcccttcctgaaatgtttatcaagagtttctttttctctcttcagcagcttgttggtgtagtcacctctcattgtggatttttaatcaatttgatctaaacatggaaaagcaaattttactttccacagatgggcaggatgtagtgaaagtccagagaaggttctcaccaaatgtgtgcagctcggaagaaaaaggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaa

SEQ ID NO: 905 - DNA, 1737 bp, Artificial Sequence
  Synthetic polynucleotide
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtga

SEQ ID NO: 906 - DNA, 284 bp, Artificial Sequence
  Synthetic polynucleotide
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatga

SEQ ID NO: 907 - DNA, 856 bp, Artificial Sequence
  Synthetic polynucleotide
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagcc

SEQ ID NO: 908 - DNA, 802 bp, Artificial Sequence
  Synthetic polynucleotide
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaacc

SEQ ID NO: 909 - DNA, 561 bp, Artificial Sequence
  Synthetic polynucleotide
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacatt

SEQ ID NO: 910 - DNA, 582 bp, Artificial Sequence
  Synthetic polynucleotide
aggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcgactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgagtctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaag

SEQ ID NO: 911 - DNA, 681 bp, Artificial Sequence
  Synthetic polypeptide
atgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgacgaggtcaggagttcaagaccagcctgaccaacatggtgaaaccccgtctctactaaaaatacaaaaaattagctgggcatggtggcatgcacctgtaatcccagctactcaggaggctgaggcaggagaatcgcttgaacccgggagccggaggttgcagtgagtcgagatcatgccactgcactccagcctgggcaacaagagtgagactccatctaaaaaaaaaaaaaaaaaaaaaaa

SEQ ID NO: 912 - DNA, 211 bp, Artificial Sequence
  Synthetic polypeptide
atggctgcctttccccacaagattatatttttcctggtatgctctactttgacacatgtggctttctcagaaactccaggaggaatgcatcactgctgacatcttgactttaggacttctcacctccagaattgtaagataataaatttgtgttttgttaagtcactaagtttgtgacaattcattacaacagcaataagaaaatagtaca

SEQ ID NO: 913 - DNA, 856 bp, Artificial Sequence
  Synthetic polypeptide
atggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggctcatggaagaccacgctttctagtccacttgaagttcagcaggcatatgactcttctagctaatgacatatgaacaaaagaaataagagtggcttccaggcttagacaatgaaaagtccatgaggaatttttaaagtcttcttctccccatgatattgtgatagtggggcaagcctcaggtagagatggcgaagccataagaccaaggcagcttggagccctgagaaatcaaatggagggccttgattctgaattgccccttggaactgcagtgcactatgtgacagtgagaaataaccttctgttgctctaagccactgaaatatgagtgtctttacaacagcataattaagtttattctgactaa

SEQ ID NO: 914 - DNA, 3388 bp, Artificial Sequence
  Synthetic polypeptide
atgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagcctggcctctgcccaccactccccagaaacggcgctcgcctaggcc

SEQ ID NO: 915 - DNA, 3346 bp, Artificial Sequence
  Synthetic polypeptide
atgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagcctggcctctgcccaccactccccagaaacggcgctcgcctaggcc

SEQ ID NO: 916 - DNA, 1396 bp, Artificial Sequence
  Synthetic polypeptide
atggacggcaccactgcccctgtcactaaatctggagctgccaagttagttaagagaaatttccttgaggcgctaaagtccaatgacttcggaaaattgaaggctattttgatccaaaggcaaatagatgtggacactgtttttgaagtcgaagatgagaatatggttttggcatcttataaacaaggttactggttgcctagctataaattgaagtcttcctgggccacaggcctccatctctctgtcttgtttggccatgtggaatgtcttctggtgctactggaccacaatgctacaatcaactgtagacccaatgggaaaacccctcttcacgtggcttgtgaaatggccaatgtggattgtgttaagatcctctgtgatcgtggggcaaagctcaattgctactccttaagtggacacacagctttgcacttttgtacaactccaagttccattctctgtgccaagcaattggtttggagaggggcgaatgtgaacatgaagaccaacaaccaagatgaggagacgcccttgcacacggctgcccacttcggcctttcggagctggtggccttctacgtggaacacggggccatagtggacagcgtgaatgcccacatggagacccccctggccatcgccgcctactgggccctccgctttaaggagcaggagtacagcacggagcaccacctggtctgccgcatgctgcttgactacaaagccgaagtcaatgcccgagatgacgactttaaatctcccctccacaaggcagcctggaactgtgaccacgtgctcatgcacatgatgctggaagctggcgccgaagccaatctcatggatatcaacggctgtgctgccatccagtacgtgctgaaggtcacctccgtgcgccctgctgcccagcctgagatctgctaccagctcctgttgaaccatggggctgcccgaatataccctccacagttccataaggtgatacaggcctgccattcttgtcctaaagcaattgaagttgtagtcaatgcctatgaacacatcagatggaacacaaagtggagaagagctatccccgatgatgacttggagcaacttggatggagctggaggccattattctaagtgaagtaactcaggaatggaaagtgaaataccatatgttctcacttataagtgggagctaagcaatgaggatgcaaagacatccagagtgatataatggactatggggacttgcaaggggaagcttgagagtggggtgagggataaaagactacatattgggtacagtgtacactgctccagtgatgggtgcactaaaatctcaaaattcaccactaaagaatgtatccatgtaaccaaaaaccacctgtacccccaaaactattgaaat

SEQ ID NO: 917 - DNA, 351 bp, Artificial Sequence
  Synthetic polypeptide
atggctgcctttccccacaagattatatttttcctggtatgctctactttgacacatgtggctttctcagagggaggcaggagggcccaagtcagagaagatgtgacaatggaagcagaagttagaatggtgcagtaaaagggccatgggccgaggaactcagacagcctgtagaagctggaaaaggtaaggaaattaattcttccttagaaactccaggaggaatgcatcactgctgacatcttgactttaggacttctcacctccagaattgtaagataataaatttgtgttttgttaagtcactaagtttgtgacaattcattacaacagcaataagaaaatagtaca

SEQ ID NO: 918 - DNA, 487 bp, Artificial Sequence
  Synthetic polypeptide
atggccggcgcggcggcggagtcagggcgggagctgtggaccttcgcgggttcccgggacccgagcgcaccgcggctagcctacggctacggcccgggcagcctgcgcgagctgcgggcgcgcgagttcagccgcctggcagataccaagactattcaacgagggaaataacttcttcaataagtgatattgggacaactggatatcaacatgcaaaagaacgaacttggacccctacctcattctgcattcaaaaattaactcaatggatcaaatacctaaatatgaaacagctaaaagtataatattcttagagtaatatataagcataaatcactaggaccttgttgaattagacaataatttcttatgacaccaaaaatgcaacaacataaatagacaaattggattttatcaaacttaaaaagaacttgtatgtttcaatgaacaccatcaagaaagtgaaaggacaacccaccaaatgaga

SEQ ID NO: 919 - DNA, 500 bp, Artificial Sequence
  Synthetic polypeptide
atgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggcacagtggctcacgcctgtaatcccagcactttgagaggccgaggtgggcggatcacctgaggtcaggagttcgagaccagcctgaccaacatggagaaaccccgtctctactaaaaatacaaaattagccaggcgtggtcatgcatgcctgtaatcccggctactcaggaggctgaagcaggagaatcacttgaacctgggagccgaaatcgcgccattgcactccagcctgggcaacaagagcgaaactccatctccaaaaaaaaaaaaa

SEQ ID NO: 920 - DNA, 2161 bp, Artificial Sequence; identical to SEQ ID NO: 288
  Synthetic polypeptide

SEQ ID NO: 921 - DNA, 2140 bp, Artificial Sequence; identical to SEQ ID NO: 289
  Synthetic polypeptide

SEQ ID NO: 922 - DNA, 529 bp, Artificial Sequence; identical to SEQ ID NO: 287
  Synthetic polypeptide

SEQ ID NO: 923 - DNA, 276 bp, Artificial Sequence
  Synthetic polypeptide
atgggcctagagctgtttcttgacctggtgtcccagcccagccgcgccgtctacatcttcgccaagaagaatggcatccccttagagctgcgcaccgtggatttggtcaaagggcagcacaagagcaaggagttcttgcagatcaacagcctggggaaactgccgacgctcaaggatggtgatttcatcttgaccgaaagggcggctgctggcatatcacagagatgaggttctcaaaatgcaaagcagaaggtccagccaagagtcggtgcccaa

SEQ ID NO: 924 - DNA, 1420 bp, Artificial Sequence
  Synthetic polypeptide
atgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 925 - DNA, 1336 bp, Artificial Sequence
  Synthetic polypeptide
atgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaagagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 926 - DNA, 1069 bp, Artificial Sequence
  Synthetic polypeptide
atggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 927 - DNA, 1345 bp, Artificial Sequence
  Synthetic polypeptide
atgaagtgggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaa

SEQ ID NO: 928 - DNA, 117 bp, Artificial Sequence
  Synthetic polypeptide
atggagaagcccctcttcccattagtgcctttgcattggtttggctttggctacacagcactggttgtttctggtgggatcgttggctatgtaaaaacagcagccctagcaaaccaa

SEQ ID NO: 929 - DNA, 51 bp, Artificial Sequence
  Synthetic polypeptide
gtttctggtgggatcgttggctatgtaaaaacagcagccctagcaaaccaa

SEQ ID NO: 930 - DNA, 734 bp, Artificial Sequence
  Synthetic polypeptide
atggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccgggggctgccggggccatgaggtggaggacgtggacctggagctgttcaacacctcggtgcagctgcagccgcccaccacagccccaggccctgagacggcggccttcattgagcgcctggagatggaacaggcccagaaggccaagaacccccaggagcagaagtccttcttcgccaaataccaccggaggagcgtgagccccagggggcacggacttgtgtttttttctgctgtgtc

SEQ ID NO: 931 - DNA, 914 bp, Artificial Sequence
  Synthetic polypeptide
atggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaa

SEQ ID NO: 932 - DNA, 251 bp, Artificial Sequence
  Synthetic polypeptide
atgcagtggcggctccaggtgaaccgcctccaggagctcatcgaccagctcgagtgcaaggccccccggctggaacccctgcgtgaagaggacctggccaaggggcctgacttgcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaa

SEQ ID NO: 933 - DNA, 1016 bp, Artificial Sequence
  Synthetic polypeptide
atggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcaccttgggaggccaaggtgggaggattacttgagcctgggagatagaagctgcagtaagccgtgatcccacacaccactgcactccagcctgggtgagagcaagaccctgtcttaaaaaacaaacaaacagaaaaa

SEQ ID NO: 934 - DNA, 1284 bp, Artificial Sequence
  Synthetic polypeptide
atggctgcacttcgtgacgctgagatacagaaggacgtgcagacctactacgggcaggtgctgaagagatcggcagacctccagaccaacggctgtgtcaccacagccaggccggtccccaagcacatccgggaagccttgcaaaatgtacacgaagaagtagccctaagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtggaagtggctgaaaagtatcttgactatcacatggaaaaatatggcttccaggcatctaatgtgacttttattcatggctacattgagaagttgggagaggctggaatcaagaatgagagccatgatattgttgtatcaaactgtgttattaaccttgtgcctgataaacaacaagtgcttcaggaggcatatcgggtgctgaagcatggtggggagttatatttcagtgacgtctatacgagccttgaactgccagaagaaatcaggacacacaaagttttatggggtgagtgtctgggtggtgctttatactggaaggaacttgctgtccttgctcaaaaaattgggttctgccctccacgtttggtcactgccaatctcattacaattcaaaacaaggaactggaaagagttatcggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggtctttggattataactcaaccaattgccaatcacaaaatctttgaatctgcctgtgacctggaaatccccacttccagttgtcccacgtttctggtctgaaccaatgtacatattatatgtattgattgatgtcttatgtctctctaaaatgtataaaaccaagttatagggtgaccactttgggcacatgtttgcagatctcctgagggctgtgtcacaggccattggtcacttatttggctcagaataaatctttttaagt

SEQ ID NO: 935 - DNA, 1727 bp, Artificial Sequence
  Synthetic polypeptide
atggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggaagtgagcagcgtctctgcttggctgcccatcgtctgggatgtgaggagcccctgtgcctggccaccccatctgggaagtgaggcgcgcctctgcctggctgccaccacgtctaggaagtgaggagcgtctctgcctggccgcccatcatctgggatgtgaggagcccctctgcctggccgccccgtctgggaagtgaggagtgcctctgcccagtcgccccatctgggaggtgaggagcgcctctgcctggccgccccgtctgggagggttaaatggattaagggcggtgcaagatgtgctttgttaaacagatgcttgaaggcagcatgctcattaagagtcatcaccactccctaatctcaagtacccagggacacaaacagggccgaaggccgcagggacctctgcctaggaaaaccagagacctttgttctggtgtttatctgctggccttctctccactattatcctatgaccctgccacatccccctctctgagaaacacccaaaaatgatc

SEQ ID NO: 936 - DNA, 746 bp, Artificial Sequence
  Synthetic polypeptide
atgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggaagtgagcagcgtctctgcttggctgcccatcgtctgggatgtgaggagcccctgtgcctggccaccccatctgggaagtgaggcgcgcctctgcctggctgccaccacgtctaggaagtgaggagcgtctctgcctggccgcccatcatctgggatgtgaggagcccctctgcctggccgccccgtctgggaagtgaggagtgcctctgcccagtcgccccatctgggaggtgaggagcgcctctgcctggccgccccgtctgggagggttaaatggattaagggcggtgcaagatgtgctttgttaaacagatgcttgaaggcagcatgctcattaagagtcatcaccactccctaatctcaagtacccagggacacaaacagggccgaaggccgcagggacctctgcctaggaaaaccagagacctttgttctggtgtttatctgctggccttctctccactattatcctatgaccctgccacatccccctctctgagaaacacccaaaaatgatc

SEQ ID NO: 937 - DNA, 767 bp, Artificial Sequence
  Synthetic polypeptide
atgttaccatttctgtttttttccaccctgttttcttccatatttactgaagctcagaagcagtattgggtctgcaactcatccgatgcaagtatttcatacacctactgtgataaaatgcaatacccaatttcaattaatgttaacccctgtatagaattgaaaagatccaaaggattattgcacattttctacattccaaggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaaggaagaagaagtaaaaactaaaaggcagaaatgaaatccacaggcagacagcccggcgtgctgcgccctgggcctggtaaagatcaacccctgaccgattccagacattgtatggaaaagcattgtgaaaatccctgtcctgttctgttctgattacctgtgcttgcagccccctgttacgtaccccctgcttgctcaatcgatcacgaccctcttacgcggacccccttagagttgtaagcccttaaaagggacaggaattgctcagtcggagagctcggtttttggagacgtgagtctgcccggtgcttccagctgaataaagccctttccttccacaacttggtgtctgaggggttgttgtctgcagctcattctgctaca

SEQ ID NO: 938 - DNA, 677 bp, Artificial Sequence
  Synthetic polypeptide
atgttaccatttctgtttttttccaccctgttttcttccatatttactgaagctcagaagcagtattgggtctgcaactcatccgatgcaagtatttcatacacctactgtgggagagatttaaagcaattatatttcaatctctatataactgtcaacaccatgaatcttccaaagcgcaaagaagttatttgccgaggatctgatgacgattactctttttgcagagctctgaagggagagactgtgaatacaacaatatcattctccttcaagggaataaaattttctaaggaagaagaagtaaaaactaaaaggcagaaatgaaatccacaggcagacagcccggcgtgctgcgccctgggcctggtaaagatcaacccctgaccgattccagacattgtatggaaaagcattgtgaaaatccctgtcctgttctgttctgattacctgtgcttgcagccccctgttacgtaccccctgcttgctcaatcgatcacgaccctcttacgcggacccccttagagttgtaagcccttaaaagggacaggaattgctcagtcggagagctcggtttttggagacgtgagtctgcccggtgcttccagctgaataaagccctttccttccacaacttggtgtctgaggggttgttgtctgcagctcattctgctaca

SEQ ID NO: 939 - DNA, 733 bp, Artificial Sequence
  Synthetic polypeptide
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 940 - DNA, 577 bp, Artificial Sequence
  Synthetic polypeptide
atggaagataaggacagagagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 941 - DNA, 613 bp, Artificial Sequence
  Synthetic polypeptide
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 942 - DNA, 601 bp, Artificial Sequence
  Synthetic polypeptide
atgacaacctgcaaagcaggtgtcgtgcctcttgcttcacagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 943 - DNA, 736 bp, Artificial Sequence
  Synthetic polypeptide
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 944 - DNA, 862 bp, Artificial Sequence
  Synthetic polypeptide
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagagggtggaagccttgtgttctcagcccagggtcctgaactctcctgctctgtctggggaaggggaggacctgggggcgtcccagcctctctctctcgaccccaccagctgccaccctgttccccagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 945 - DNA, 709 bp, Artificial Sequence
  Synthetic polypeptide
atggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 946 - DNA, 826 bp, Artificial Sequence
  Synthetic polypeptide
atggcttcgcgctgctggcgctggtggggctggtcggcgtggcctcggacccggctgcctcccgccgggagcaccccgacctttgggggttcagatgaagtaagagaccctgcaaatgccaaagccttgaggaacaagagaaggaggatgcaggtgagggtgaagcttgggaagttccagcttctgttggatattcaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 947 - DNA, 580 bp, Artificial Sequence
  Synthetic polypeptide
atggaagataaggacagagagcagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggagatcacaagctctgagagggcctgctccttgtctcttttcctcaccattgaccaccccgcccctccaagctctttgcatgggggtgagcacatggtagaggcccactacatacttgttgaatgaa

SEQ ID NO: 948 - DNA, 1398 bp, Artificial Sequence
  Synthetic polypeptide
atggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaa

SEQ ID NO: 949 - DNA, 1302 bp, Artificial Sequence
  Synthetic polypeptide
atggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagggccaggtgaggtggctcacacctgtaatcccagcactttgggaggccaaggcaggcggatcacctgaggtcaggagttcaatactagcctggccaacatgatgaaaccccatctctactaaaaacacaaaaagtagccaggcgtggtggcacgtgcctgtaatcccagctactcgggaggctgaagcaggagaatcgcttgaacctgggaggtggaggttgcagtgagctgagatcgtgccaccgcactccagcctgggcaatggagccagactctgtctcaaaaaaataaataaataaataaaa

SEQ ID NO: 950 - DNA, 960 bp, Artificial Sequence
  Synthetic polypeptide
atgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 951 - DNA, 402 bp, Artificial Sequence
  Synthetic polypeptide
atgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 952 - DNA, 1111 bp, Artificial Sequence
  Synthetic polypeptide
gacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 953 - DNA, 384 bp, Artificial Sequence
  Synthetic polypeptide
atgcccaggacttctacgactggctgcaggagacagacgtggatctctctggggtcaagttcgcgcttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 954 - DNA, 657 bp, Artificial Sequence
  Synthetic polypeptide
atgggctcccggtggcctgcggtgcctccctggggactccagatccatgtatctgaaaggcagccctccagacccccaccctgtcctcagcagccagggcaggccacttgtgagaccctctcctctgccccagaccccagcactacgagaatgtcccctccctgtccccagccccagtcggctccagggggcattgggtgctggagactaaaggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 955 - DNA, 757 bp, Artificial Sequence
  Synthetic polypeptide
atgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaaatgcggccaaggtgtacatgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 956 - DNA, 174 bp, Artificial Sequence
  Synthetic polypeptide
atgggggagatgggccggctgaagagctacgagaaccagaagccctgctcaggaggctgaggcaggagaattgcttgaacctgggaggcagaggttgcagtgagccgagatcgcgccgctgcactccagcctgggtggcagagcgaaactctgtctcaaaaaaaaaaaagagaa

SEQ ID NO: 957 - DNA, 84 bp, Artificial Sequence
  Synthetic polypeptide
atgatgagtcatccgtgtgtgtctcttttgggccatattaattcagccagaactgaacacctgacccaagggcagcaagcaatc

SEQ ID NO: 958 - DNA, 355 bp, Artificial Sequence
  Synthetic polypeptide
atggctcttacacaggatgtgggcaaactcacgactgcgcctgccgccagaaggtttgctgagggccgtcactccctggcgccgggctccttgaagttatctactgggaaatctagagcttattgttggaaggatgcagtcttgcaagcctgctgtgatccaaacggccgactgagttaccaacaatcacccccacttctggttatctcttttacctaataaatttggagggctgaaaaagctcagggcccttgtccactagaggcaagatgccccctggccccttcttccaaatatactctcttgtctttttcttttattcccgcgttcacccgctttgttcagtccaccaggg

SEQ ID NO: 959 - DNA, 1007 bp, Artificial Sequence
  Synthetic polypeptide
atggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaataggcagaatctttggcggtatggggaaataattcgacggatcctggg

SEQ ID NO: 960 - DNA, 1481 bp, Artificial Sequence
  Synthetic polypeptide
atgctggccaagggtcttcccccacgctcagtcctggtcaaaggctgccagacctttctgagtgcccccagggaggggctggggcgtctcagggtgcccactggcgagggagctggcatctccacccgcagtcctcgccccttcaatgagatcccctctcctggtgacaatggctggctaaacctgtaccatttctggagggagacgggcacacacaaagtccaccttcaccatgtccagaatttccagaagtatggcccgatttacagggagaagctcggcaacgtggagtcggtttatgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgatggctccagaggccaccaagaactttttgcccctgttggatgcagtgtctcgggacttcgtcagtgtcctgcacaggcgcatcaagaaggcgggctccggaaattactcgggggacatcagtgatgacctgttccgctttgcctttgagtccatcactaacgtcatttttggggagcgccaggggatgctggaggaagtagtgaaccccgaggcccagcgattcattgatgccatctaccagatgttccacaccagcgtccccatgctcaaccttcccccagacctgttccgtctgttcaggaccaagacctggaaggaccatgtggctgcatgggacgtgattttcagtaaagctgacatatacacccagaacttctactgggaattgagacagaaaggaagtgttcaccacgattaccgtggcatcctctacagactcctgggagacagcaagatgtccttcgaggacatcaaggccaacgtcacagagatgctggcaggaggggtggacacgacgtccatgaccctgcagtggcacttgtatgagatggcacgcaacctgaaggtgcaggatatgctgcgggcagaggtcttggctgcgcggcaccaggcccagggagacatggccacgatgctacagctggtccccctcctcaaagccagcatcaaggagacactaagacttcaccccatctccgtgaccctgcagagatatcttgtaaatgacttggttcttcgagattacatgattcctgccaagacactggtgcaagtggccatctatgctctgggccgagagcccaccttcttcttcgacccggaaaattttgacccaacccgatggctgagcaaagacaagaacatcacctacttccggaacttgggctttggctggggtgtgcggcagtgtctgggacggcggatcgctgagctagagatgaccatcttcctcatcaataggcagaatctttggcggtatggggaaataattcgacggatcctggg

SEQ ID NO: 961 - DNA, 460 bp, Artificial Sequence
  Synthetic polypeptide
atggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggctcataggcagaagggacttgccttatcttggatgagactttggactgtggacttttgaattaatgctgaaaagagttaagactgttggaaaggcatgattggttttgaaatgtgaggacatgagatttgggagggaccaggggcagaa

SEQ ID NO: 962 - DNA, 2721 bp, Artificial Sequence
  Synthetic polypeptide
atggcagcctccttacggctcctcggagctgcctccggtctccggtactggagccggcggctgcggccggcagccggcagctttgcagcggtgtgttctaggtcagtggcttcaaagactccagttggattcattggactgggcaacatggggaatccaatggcaaaaaatctcatgaaacatggctatccacttattatttatgatgtgttccctgatgcctgcaaagagtttcaagatgcaggtgaacaggtagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgtaaggaccattgtaaacaaagaaaagaatagtcatgaacccatcactgcagctactccagcaggcttgcactttttgcagaacatctttttatctcacattgaaaatgcagcttttatgtagatgcaggattgctgtagaaaggcatacttacatctaatatgattcaagaaaaatatgacaacttaaagcaaaaagaaagtgaaggatctaaagctggagaatttaatgccagcaaaggatggtttgataattttaggaagaggtttgcttaaaaaatgtcaagaaataggcgaagtagcttctgccaaccaagagacagcagacagttcccaggcgccattaagaaaaaatcattgaagagaaagtatatctgcctgaatgagtttttaatgcagacagaagtgccctattacggagaaaaaaaaaaaaaaaaggatgctcgaaggacatttattaggaagagaagcaagcagcaccaggatttaaggcaggaaaggataggctaactctactgttttgtacaaatgcagttgggttgaaaatcaggactgcccttatctataaagttgctaacttctgaggctttaagtgaaaagataaataccagctgcctgtcttttggttgtacagcaagaaggcctggacgatgagaaccctgtttctggattgtttccatcaatggctttgtctctggagtcaggcaatatcttgccagtaagggactgacttttaaagttattttgatattggacagtacccctggccacccagaataacatgagttcaacactgaaggtgtccaaggggccaacttgcccctaaacataacgcccctaattcagcctctagagtaggggatcataaggacctttaaggctcattacacatggtactctatgggaaggattgtcactgtggaagaaaaccctgatagaacatgaaaatctggaaagattacaccattgaagatgccattgttattgtggaaaacgccttgaaggccatcaagcccctaacagtaaattcctgctggaaaaaactgtccagatgttgtgcaagacttcacaggatttatggcagggccaatcaaggaaatcactaaagagattgtgcatatggcaaaaaaggtggggagtgtatgaaggctttcaagatatggatcttggattaattcaagagctaatagacaccacagcagagtaattaacagaagaggcttgatggagatgagtgcttctgaacagtaccagatgatgaggaagaagatgtaccaaaagcagtgccaggaaacaaattgacattagacagtatggcagaacggttctgattattcaagactcctttcaacttcttttacaacatggacccttctctgatacagacactgaaaataaagcaaacagtggaagacggattggtaccatacaaaaacgtttttagagaaatgaaagagcaaaaacatcagatagaaattacaatttccataaagttatccggagtgtgcctgccccttctgcctccccttctaccacctccacctcttctgcctctgtcaccccgagacagcgaagagcaacccctcctcttcctcctcagcctactcattattaagatgatgggattgaagacctttatgatgatccacttccacttaatgaataataaatatattttatcttccttaatgattcccttagtaacatttttttctctagcttgctttaccataagaatacaatatataatacatatacaaaatatgtgttaatcaactgtttatgttattgacgaggcttccagtcaacagtgggctattagtagttaagtttttggagagtcaaaagttatacatgggtttttgactgcactgggggttggcacccctaaccccctcatcattcaagggtcaactg

SEQ ID NO: 963 - DNA, 2549 bp, Artificial Sequence
  Synthetic polypeptide
ctgaattacctcatactctgaagttaccaggcttacctctgtttcccaacaagtttcttatttctttagtgttgctaattttagtatcttccccagcagatgttgctgaaaaagctgacagaattattacaatgctgcccaccagtatcaatgcaatagaagcttattccggagcaaatgggattctaaaaaaagtgaagaagggctcattattaatagattccagcactattgatcctgcagtttcaaaagaattggccaaagaagttgagaaaatgggagcagttttcatggatgcccctgtttctggtggtgtaggagctgcacgatctgggaacctcacgtttatggtgggaggagttgaagatgaatttgctgctgcccaagagttgctggggtgcatgggctccaacgtggtgtactgtggagctgttgggactgggcagtgcaataccataaaccttgaatgacaccatgggacccatacaaagtgccactagtgatgctggaagtgctcctaagaagctgagaaaagtcatgacattacaagaaaaagttgaattgcctgatacataccatggattgaggtctgcggctgcgtttgccctccatttcaagataaacaaatccaatgtaaggaccattgtaaacaaagaaaagaatagtcatgaacccatcactgcagctactccagcaggcttgcactttttgcagaacatctttttatctcacattgaaaatgcagcttttatgtagatgcaggattgctgtagaaaggcatacttacatctaatatgattcaagaaaaatatgacaacttaaagcaaaaagaaagtgaaggatctaaagctggagaatttaatgccagcaaaggatggtttgataattttaggaagaggtttgcttaaaaaatgtcaagaaataggcgaagtagcttctgccaaccaagagacagcagacagttcccaggcgccattaagaaaaaatcattgaagagaaagtatatctgcctgaatgagtttttaatgcagacagaagtgccctattacggagaaaaaaaaaaaaaaaaggatgctcgaaggacatttattaggaagagaagcaagcagcaccaggatttaaggcaggaaaggataggctaactctactgttttgtacaaatgcagttgggttgaaaatcaggactgcccttatctataaagttgctaacttctgaggctttaagtgaaaagataaataccagctgcctgtcttttggttgtacagcaagaaggcctggacgatgagaaccctgtttctggattgtttccatcaatggctttgtctctggagtcaggcaatatcttgccagtaagggactgacttttaaagttattttgatattggacagtacccctggccacccagaataacatgagttcaacactgaaggtgtccaaggggccaacttgcccctaaacataacgcccctaattcagcctctagagtaggggatcataaggacctttaaggctcattacacatggtactctatgggaaggattgtcactgtggaagaaaaccctgatagaacatgaaaatctggaaagattacaccattgaagatgccattgttattgtggaaaacgccttgaaggccatcaagcccctaacagtaaattcctgctggaaaaaactgtccagatgttgtgcaagacttcacaggatttatggcagggccaatcaaggaaatcactaaagagattgtgcatatggcaaaaaaggtggggagtgtatgaaggctttcaagatatggatcttggattaattcaagagctaatagacaccacagcagagtaattaacagaagaggcttgatggagatgagtgcttctgaacagtaccagatgatgaggaagaagatgtaccaaaagcagtgccaggaaacaaattgacattagacagtatggcagaacggttctgattattcaagactcctttcaacttcttttacaacatggacccttctctgatacagacactgaaaataaagcaaacagtggaagacggattggtaccatacaaaaacgtttttagagaaatgaaagagcaaaaacatcagatagaaattacaatttccataaagttatccggagtgtgcctgccccttctgcctccccttctaccacctccacctcttctgcctctgtcaccccgagacagcgaagagcaacccctcctcttcctcctcagcctactcattattaagatgatgggattgaagacctttatgatgatccacttccacttaatgaataataaatatattttatcttccttaatgattcccttagtaacatttttttctctagcttgctttaccataagaatacaatatataatacatatacaaaatatgtgttaatcaactgtttatgttattgacgaggcttccagtcaacagtgggctattagtagttaagtttttggagagtcaaaagttatacatgggtttttgactgcactgggggttggcacccctaaccccctcatcattcaagggtcaactg

SEQ ID NO: 964 - DNA, 1689 bp, Artificial Sequence
  Synthetic polypeptide
atggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccctaatgtgtccagcagccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctg

SEQ ID NO: 965 - DNA, 1671 bp, Artificial Sequence
  Synthetic polypeptide
atggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcggggtggtgaaggaagaaatttcagatgacaacgcccgcctcccctgcttcaacggaagggtggtatcctggctggtgtcctcagataatccccaacccgagatggcccctccagtccatgagcctcgggcagaactggcgcctccagccccacctttacctcctttgccacccgagaggaccagcggcattggggactcaaggcctccatccttccaccatgagaatctggagcctgagacagaaaccgagtcagtagtgtcactgaggcgggagcggcctcgcaggagagacagcagtgagcatggcgctgggggccacaggactggtggcccctcaaggctggagcgccacctggccggatacgagagctcctctaccctcatgaccagcgagctggagagtaccagcctgggggactcggacgaggaggacaccatgagcaggttcagcagctccacggagcagagcagtgcctcccgcctccttaagcgccaccggcggcgaaggaagcagaggccaccccgcctggagaggacgtcatccttcagcagcgtcacagattccacaatgtctctcaatatcatcacagtcacgctaaacatggagaagtacaacttcctgggtatctccattgttggccagagcaatgagcggggagacggaggcatctacattggctccatcatgaagggtggggctgtggcggccgacgggcgcattgagccaggggacatgcttttgcaggtgaatgacatgaactttgagaacatgagcaacgatgacgctgtgcgggtgctgagggacattgtgcacaagcctggccccattgtgctgactgtggccaagtgctgggatccctctcctcaggcctatttcactctcccccgaaatgagcccatccagccaattgaccctgctgcctgggtgtcccattccgcggctctgactggcaccttcccagcctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctg

SEQ ID NO: 966 - DNA, 650 bp, Artificial Sequence
  Synthetic polypeptide
tgaactttgagaacatgagcaacgatgacgctgtgcgggtgctgagggacattgtgcacaagcctggccccattgtgctgactgtggccaagtgctgggatccctctcctcaggcctatttcactctcccccgaacctatccaggttcctcctccatgagcaccattacatctggatcgtctttgcctgatggctgtgaaggccggggtctctccgtccatacggacatggcatcggtgaccaaggccatggcagctccagagtctggactggaagtccgggaccgcatgtggctcaagatcaccatccctaatgcctttctgggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctg

SEQ ID NO: 967 - DNA, 645 bp, Artificial Sequence; identical to SEQ ID NO: 137
  Synthetic polypeptide

SEQ ID NO: 968 - DNA, 384 bp, Artificial Sequence
  Synthetic polypeptide
atggctgcctttccccacaagattatatttttcctggtatgctctactttgacacatgtggctttctcaggtggaacaatataatcacaaggattcttatcagagggaggcaggagggcccaagtcagagaagatgtgacaatggaagcagaagttagaatggtgcagtaaaagggccatgggccgaggaactcagacagcctgtagaagctggaaaaggtaaggaaattaattcttccttagaaactccaggaggaatgcatcactgctgacatcttgactttaggacttctcacctccagaattgtaagataataaatttgtgttttgttaagtcactaagtttgtgacaattcattacaacagcaataagaaaatagtaca

SEQ ID NO: 969 - DNA, 1041 bp, Artificial Sequence
  Synthetic polypeptide
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctgatgtgatggctggaattccagtcaccattttggaccatgaggacaacaccctagagatgtggagtggctaaaagaagcctgtgttcctgagaacttagaggaccaggacctctattccaggcttggacacctacatttagactattatatgaggaagcaatcaacttctcacttgtttcaaccactttcacttgcagtcaaacctgaattgtaagtga

SEQ ID NO: 970 - DNA, 877 bp, Artificial Sequence
  Synthetic polypeptide
atgtcggacgatttcttatggtttgaaggcatagctttccctactatgggtttcagatccgaaaccttaagaaaagtacgtgatgagtttgtgataagggatgaagatgtaataatattgacttaccccaaatcaggaacaaactggttggctgagattctctgcctgatgcactccaagggggatgccaagtggatccaatctgtgcccatctgggagcgatcaccctgggtagagagtgagattgggtatacagcactcagtgaaacggagagtccacgtttattctcctcccacctccccatccagttattccccaagtctttcttcagttccaaggccaaggtgatttatctcatgagaaatcccagagatgttttggtgtctggttattttttctggaaaaacatgaagtttattaagaaaccaaagtcatgggaagaatattttgaatggttttgtcaaggaactgtgctatatgggtcatggtttgaccacattcatggctggatgcccatgagagaggagaaaaacttcctgttactgagttatgaggagctgaaacaggtgcggtggttcacatccataatcccagcactttgggaggctgaggtgggcagatcacctgagctcaggagttggaacccagcttggccaacatggtgatactccctctctactaaaaatacgtaaattagccgggagtggtggcgcacgcctgtaaccccagctactcgggaggttgagacaggagaattgcttgagcctgggaggcggaggttgcagtgagctgagatcatgccactgcactccagcctgggcgacagagtgagatcttgtctctaaataaatacataaataaaattttaaaaataaa

SEQ ID NO: 971 - DNA, 213 bp, Artificial Sequence
  Synthetic polypeptide
atggtatcacatcggtatcctcgaattcaaagtatcaaagtacaatttaccggttcgttggcaaaagggacttgccttgtctcagacgagactatggattttgacctttggatgaatgctgaaatgagttaagactttggggaactgttgggaaggcataattgtgttttgaaatgtgagaaacaggagatttgggagggaccaggggtagaa

SEQ ID NO: 972 - DNA, 363 bp, Artificial Sequence
  Synthetic polypeptide
atggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccggttcgttggcaaaagggacttgccttgtctcagacgagactatggattttgacctttggatgaatgctgaaatgagttaagactttggggaactgttgggaaggcataattgtgttttgaaatgtgagaaacaggagatttgggagggaccaggggtagaa

SEQ ID NO: 973 - DNA, 822 bp, Artificial Sequence; identical to SEQ ID NO: 119
  Synthetic polypeptide

SEQ ID NO: 974 - DNA, 806 bp, Artificial Sequence
  Synthetic polypeptide
atggtgttgctgagagtgttaattctgctcctctcctgggcggcggggatgggaggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaagacatttcaacctacgaatgaagagggacacttcccttttcagtgatgaatttaaagtagaaacatcaaataaagtacttgattatgatacctctcatatttacactggacatatttatggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattaactatccccataaatacggtcctcaggggggctgtgcagatcattcagtatttgaaagaatgaggaaataccagatgactggtgtagaggaagtaacacagacactcttgcttgctcctgcttccagcatgtcatgtgcctgctcccccttcaccttctgcccatgcttataagcttcctgagacctctctagaagccaagcggatgccagcaccatgcttcctgtaaagcctgcagaacgatgagccaattaaaactcttttcttgataaattactcagtctcagttatttctttataacaacgcaaaaatggcctaatac

SEQ ID NO: 975 - DNA, 193 bp, Artificial Sequence
  Synthetic polypeptide
atggcctggtggaaagcctgggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaa

SEQ ID NO: 976 - DNA, 1398 bp, Artificial Sequence; identical to SEQ ID NO: 948
  Synthetic polypeptide

SEQ ID NO: 977 - DNA, 1302 bp, Artificial Sequence; identical to SEQ ID NO: 949
  Synthetic polypeptide

SEQ ID NO: 978 - DNA, 3992 bp, Artificial Sequence; identical to SEQ ID NO: 120
  Synthetic polypeptide

SEQ ID NO: 979 - DNA, 3845 bp, Artificial Sequence; identical to SEQ ID NO: 121
  Synthetic polypeptide

SEQ ID NO: 980 - DNA, 1236 bp, Artificial Sequence
  Synthetic polypeptide
atgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagaacatctcaccagactagggatctgccaaactttgggaaattctg

SEQ ID NO: 981 - DNA, 749 bp, Artificial Sequence
  Synthetic polypeptide
atgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggcctggcacagggtcagtgctccagaaagatggattgattgaat

SEQ ID NO: 982 - DNA, 386 bp, Artificial Sequence
  Synthetic polypeptide
atgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagtcaccccatactcgacgatcgacacgtggccaggccggcggagcggaggcatgatcgtcatcacttccatcctgggctccctgcccttctttctacttgtgggttttgctggcgccattgccctcagcctcgtggcctggcacagggtcagtgctccagaaagatggattgattgaat

SEQ ID NO: 983 - DNA, 999 bp, Artificial Sequence
  Synthetic polypeptide
atgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacagggttccacagagctgagccccttgggtctaccctttgtactcttctcaccaactagattgttggagatttctcgacctatgccttcaggtactacatgataacagcttatttccaaagccatatctgtagtcgttcctctcttgtgagcttggaccctgtatccttttgcctactggcaaagccccaggtgtatctaaaattcagcttatctaaagcatgattcactgtccttcctttcaaaacctaattcttgttctgtacagcctattttcatgaaaagcactacctagactctgtctggttggcaggccagaaacttcagag

SEQ ID NO: 984 - DNA, 4805 bp, Artificial Sequence
  Synthetic polypeptide
atggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatgcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttagggtgacaacctcccagctggcagtgccgcccaccacgtgcactgtgctgctgctggcagagagcgagggggagcgggaacgctggctgcaggtgctgggtgagctgcagcggctgctgctggacgcgcggccaagaccccggcccgtgtacacactcaaggaggcttacgacaacgggctgccgctgctgcctcacacgctctgcgctgccatcctcgaccaggatcgacttgcgcttggcaccgaggaggggctctttgtcatccatctgcgcagcaacgacatcttccaggtgggggagtgccggcgcgtgcagcagctgaccttgagccccagtgcaggcctgctggtcgtgctgtgtggccgcggccccagcgtgcgtctctttgccctggcggagctggagaacatagaggtagcaggtgccaagatccccgagtctcgaggctgccaggtgctggcagctggaagcatcctgcaggcccgcaccccggtgctctgtgtagccgtcaagcgccaggtgctctgctaccagctgggcccgggccctgggccctggcagcgccgcatccgtgagctgcaggcacctgccactgtgcagagcctggggctgctgggcgaccggctatgtgtgggcgccgccggtggctttgcactctacccgctgctcaacgaggctgcgccgttggcgctgggggccggtttggtgcctgaggagctgccaccatcccgcgggggcctgggtgaggcactgggtgccgtggagcttagcctcagcgagttcctgctactcttcaccactgctggcatctacgtggatggcgcaggccgcaagtctcgtggccacgagctgttgtggccagcagcgcccatgggctgggggtatgcggccccctacctgacagtgttcagcgagaactccatcgatgtgtttgacgtgaggagggcagaatgggtgcagaccgtgccgctcaagaaggtgcggcccctcaatccagagggctccctgttcctctacggcaccgagaaggtccgcctgacctacctcaggaaccagctggcagagaaggacgagttcgacatcccggacctcaccgacaacagccggcgccagctgttccgcaccaagagcaagcgccgcttctttttccgcgtgtcggaggagcagcagaagcagcagcgcagggagatgctgaaggacccttttgtgcgctccaagctcatctcgccgcctaccaacttcaaccacctagtacacgtgggccctgccaacgggcggcccggcgccagggacaagtccccggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtgacccaccaggatcatcttcaaaggagccttcctggccgcttggtcaggtagtcattgcctccctggggctggtgccacctttgccaccccgctccctccacaccttccttgcagcttctgctgtgctgtgggtttcttctggtgcctgttctcctctgttgactgtgggctccttggtggtgggggtcaggcttcattcttct

SEQ ID NO: 985 - DNA, 1379 bp, Artificial Sequence
  Synthetic polypeptide
atgaacgccagcggttctggctacccgcttgcctcgctttacgtgggcgatctgcaccccgacgtgaccgaggccatgctctatgagaagttctctcccgccggccccatcctgtccatccgcgtgtgccgcgatgtagccacccggcgctcgctgggctacgcctacatcaacttccagcagcccgcggacgcggagcgggcactggacacaatgaactttgagatgctcaaaggccagcctattcgcatcatgtggtcccagcgagacccaggacttcgcaagtcaggtgtgggcaacatcttcatcaagaacctggaggactccattgacaacaaggctttatatgataccttctccacctttgggaacatcctctcttgcaaggtggcgtgtgacgagcatggctcccggggtttcggctttgtccattttgagacccatgaggccgcacagcaggccatcaacaccatgaatgggatgctgctgaatgaccgcaaagtctttgtgggtcacttcaagtctcgacgggagcgggaggcggagctgggggcgcgggccctggagttcaccaacatctacgtgaagaacctcccggtggatgtggacgagcaaggcctgcaggacctcttctcccagtttgggaaaatgctgagtgtgaaggtgatgagggacaacagcggccactcgcggtgctttggctttgtcaactttgagaagcatgaggaagcccagaaggccgtggtccatatgaacgggaaggaggtgagcgggcggctgctgtacgcgggccgggcccaaaagcgcgtggagcggcagaatgaactgaagcgcaggtttgagcagatgaagcaggaccggctgaggcgttaccagggtgtgaacttgtatgtgaagaatctggacgactccattgatgacgacaaactgaggaaagagttctctccctatggagtaattaccagtgcgaaggtgatgacagagggtggccacagcaaggggtttggctttgtgtgtttttcctccccagaagaggcgacaaaggccgtgacagagatgaacgggcgcatcgtgggcaccaagccactctacgtggcactggcccagcgcaaagaggagcggaaggccatcttgaccaaccagtacatgcagcgcctctccaccatgcggaccctgagcaaccccctcctgggctcctttcagcagccctccagctacttcctgcctgccatgccccagcctccagcccaggctgcatactatggctgtggcccagtgacacccacccagcctgcccccaggtggacatcccagccacctagaccttcctgtgggtgacttcacttctctgagcctcagtttcctcttctgagcatggg

SEQ ID NO: 986 - DNA, 1081 bp, Artificial Sequence
  Synthetic polypeptide
atgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatgtgagttcattacattccttctac

SEQ ID NO: 987 - DNA, 1054 bp, Artificial Sequence
  Synthetic polypeptide
atgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacaggtgacatgacatgagaattgccttaaaatactcaaggaaaaaaatcctactgctgggtgtgggaggtgcttgatgaaatgagatctgcaaattgttaatagtgattcctgagtgagcacatgtgagttcattacattccttctac

SEQ ID NO: 988 - DNA, 1146 bp, Artificial Sequence
  Synthetic polypeptide
atgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaa

SEQ ID NO: 989 - DNA, 1731 bp, Artificial Sequence
  Synthetic polypeptide
atgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcagcctgactctgcctctctgtctgcaggagcctggtcgggctatggccatgtggccgcctgccagctaatgggcccccacaccctggccttgagggtgggagagagccagctcctcctgcagagcccccaggcggaggttgcagtgagccgaggcacttcagcctggcaacagagcaagactccgtct

SEQ ID NO: 990 - DNA, 2262 bp, Artificial Sequence
  Synthetic polypeptide
atgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggcggaggttgcagtgagccgaggcacttcagcctggcaacagagcaagactccgtct

SEQ ID NO: 991 - DNA, 2253 bp, Artificial Sequence
  Synthetic polypeptide
atgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccagcttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggcggaggttgcagtgagccgaggcacttcagcctggcaacagagcaagactccgtct

SEQ ID NO: 992 - DNA, 434 bp, Artificial Sequence
  Synthetic polypeptide
atgcgcacggcggacggaggcgagccggccggggcttcctccccggccggcagggtggacggtgggctcggtctttgcatgcaccaccacatctggctaatcaagtgaagatgaggccaaactggatgaaggcgggcctgaaatccaacgactggtgaccttataaggagggagagcttcaaagacccaggcagtcatagagggaagaagggcaagtggcaaagaagacagagattgggtttctgttgccaccgaggctgccagaagaggcaaggaagaatcctcccctagagccttcagaggcagatgcctggccctgctgacggtttggttttgaacttttagcctccagaactgtgcaagaataaatttctgttgttttaagccatcgggtttgtggtaatttgttatggcagctctaggaaactaatcca

SEQ ID NO: 993 - DNA, 1221 bp, Artificial Sequence; identical to SEQ ID NO: 122
  Synthetic polypeptide

SEQ ID NO: 994 - DNA, 413 bp, Artificial Sequence
  Synthetic polypeptide
atgctcctgtctgggggcgatcctccggcgcaggaatggttcatggtgcagacaaaatcgaagcctcgggtgcagcggcagcggctgcaagtgcagcgcatctttagggtcaagctgaacgccttccagagccgcccggacaccccctacttctggctacagctcgaggggccccgagagaacatgggcaaagccaagtatagacggcatcatggtgaagacccccgactgtggagctagagtgcctgagtatcccagcctactaactgtgtgatcttggacatatggccttccttgctcatctaaaatggggataatagtatttccttaaagggcagagagaggaataaataagataatgtgtgcaaagtgcctgacacataataagctctcactaaatattagttcatatt

SEQ ID NO: 995 - DNA, 317 bp, Artificial Sequence
  Synthetic polypeptide
atgactcgcgatttcaaacctggagacctcatcttcgccaagatgaaaggttatccccattggccagctcgagtagacgaagttcctgatggagctgtaaagccacccacaaacaaactacccattttcttttttggaactcatgagacgctcctaggtggaagagacttgccttgcctcagatgagactttggacttggacttttgagttaatgctggaatgagttaagactttgggggatggggactgttggaagggcatggttgtgttttgaaatgtgaggacatgagatttgagagagggggcaggggcagaa

SEQ ID NO: 996 - DNA, 1052 bp, Artificial Sequence; identical to SEQ ID NO: 247
  Synthetic polypeptide

SEQ ID NO: 997 - DNA, 327 bp, Artificial Sequence; identical to SEQ ID NO: 246
  Synthetic polypeptide

SEQ ID NO: 998 - DNA, 314 bp, Artificial Sequence
  Synthetic polypeptide
atgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggtcttaattctgaaaggagagcacttctaccacatgacatgatggtttcatcgatctaaaagataagaccatcacctggccttttgaggaatcctcatgtcactgaagcaacagccaagg

SEQ ID NO: 999 - DNA, 2141 bp, Artificial Sequence
  Synthetic polypeptide
atgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1000 - DNA, 2006 bp, Artificial Sequence
  Synthetic polypeptide
atgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1001 - DNA, 2045 bp, Artificial Sequence
  Synthetic polypeptide
atgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtggtttgtgatgaaaatggttccaagggctatggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttggcaagtttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1002 - DNA, 1212 bp, Artificial Sequence
  Synthetic polypeptide
ccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1003 - DNA, 1099 bp, Artificial Sequence
  Synthetic polypeptide
tcaatggaaaacaaatttatgttggtcgagctcagaaaaaggtggaacggcagacggaacttaagcgcaaatttgaacagatgaaacaagataggatcaccagataccagagaatggcaagtgtacgagctgttcccaaccctgtaatcaacccctaccagccagcacctccttcaggttacttcatggcagctatcccacagactcagaaccgtgctgcatactatcctcctagccaaattgctcaactaagaccaagtcctcgctggactgctcagggtgccagacctcatcgaaaaaccaggccatacagagataggagctgaggggacatagtgagaagtgaccagaagacaagagtgcgagccttctgttatgcccagacagggccaccaaagggctccttggtctagtggtaacgccagcgtctgggaagacgcccgttgccaggcggaccgaggtctagcagtagcgtaagtgtcaaaggaaaacacccactatttagcagaccgggaaagggagtctgcttttcccctggggagtttagagaagactgctcctccacctcttgtggagggcctgacatcagtcaggcttgcctgcaattatccagaggcctaaccgtctccctatggtgctgtgcttcagtggtcacgctcctagtctgccttcatgttccatcctgtacacctggctctgccttctagatagcagtagtaaattagtgaaagtactaaaagtctctaatatgcagaaacaatggcgtaagctgtctttctctctgtctcctctccctctctgcctcggctgccaggcggggaagggccccctctccagtggacacgtaacccacgtgaccttacctatcattggagatgactcacactctttaccctgccccttgtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctaca

SEQ ID NO: 1004 - DNA, 1420 bp, Artificial Sequence; identical to SEQ ID NO: 924
  Synthetic polypeptide

SEQ ID NO: 1005 - DNA, 1336 bp, Artificial Sequence; identical to SEQ ID NO: 925
  Synthetic polypeptide

SEQ ID NO: 1006 - DNA, 1069 bp, Artificial Sequence; identical to SEQ ID NO: 926
  Synthetic polypeptide

SEQ ID NO: 1007 - DNA, 1345 bp, Artificial Sequence; identical to SEQ ID NO: 927
  Synthetic polypeptide

SEQ ID NO: 1008 - DNA, 371 bp, Artificial Sequence
  Synthetic polypeptide
atgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagagatgatgcagcaagaaggccttctccaggtgttaccccctccagcttagacttcctggcctccagaatggtgagccaataaatatctgttttgttttgaataccagtctgtggtattctgttgtagcaatacaaaatggaccaagaca

SEQ ID NO: 1009 - DNA, 272 bp, Artificial Sequence
  Synthetic polypeptide
atgaaggaacttctgcacaaggagctgcccagctttgtgggggagaaagtggatgaggaggggctgaagaagctgatgggcagcctggatgagaacagtgaccagcaggtggacttccaggagagatgatgcagcaagaaggccttctccaggtgttaccccctccagcttagacttcctggcctccagaatggtgagccaataaatatctgttttgttttgaataccagtctgtggtattctgttgtagcaatacaaaatggaccaagaca

SEQ ID NO: 1010 - DNA, 143 bp, Artificial Sequence
  Synthetic polypeptide
atgcagaaggtgaccctgggcctgcttgtgttcctggcaggctttcctgtcctggacgccaatgacctagaagataaaaacagtcctttctactatgcaccctgtgcatcctaggtgctccatatatatttgtcaagagaatg

SEQ ID NO: 1011 - DNA, 314 bp, Artificial Sequence
  Synthetic polypeptide
atgggaagggggtatagtggggccttgcaggccagaggtggcttggaggagcccctggaaagaggcttaagaggcccgagtttcacccagtccccactccacggtgcagctgcggcttatctctcagcccagcgagatgccagccttcctgtcccgggccagcgctctgacatgcagaaggtgaccctgggcctgcttgtgttcctggcaggctttcctgtcctggacgccaatgacctagaagataaaaacagtcctttctactatgcaccctgtgcatcctaggtgctccatatatatttgtcaagagaatg

SEQ ID NO: 1012 - DNA, 603 bp, Artificial Sequence
  Synthetic polypeptide
atggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtgggagaaatttggacacagagacagacacgcacagaaggaagatgatgtaaagacacagagtaccacgtgaggctggaggactggagtgatgtatttacaacccaaggaacgtctaaggttatcagcatactgtcagaagcaaggaagaggcaaggaaggatcccctacaagtttgaaaagtgtcatggccctgctgacacatttattttggacttttagccagaactgtgagaaaataaattgctgtattttcaagtcacgcaatttgtggtacttttctatggtggccctaagaaactaata

SEQ ID NO: 1013 - DNA, 500 bp, Artificial Sequence; identical to SEQ ID NO: 204
  Synthetic polypeptide

SEQ ID NO: 1014 - DNA, 656 bp, Artificial Sequence; identical to SEQ ID NO: 205
  Synthetic polypeptide

SEQ ID NO: 1015 - DNA, 524 bp, Artificial Sequence; identical to SEQ ID NO: 207
  Synthetic polypeptide

SEQ ID NO: 1016 - DNA, 794 bp, Artificial Sequence
  Synthetic polypeptide
atgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactggacatggatgaagctggaagtcatcatcctcagcaaactaacacaggaacaggaagccagacactgcatgttccctctcataagtgggagttgaacaatgagaacacatggacaaagggaggggaacaacacacaccagggcctgctgaggggtgaggagtgaggagaagggaacttagaggatgggtcaacaggtgcagcaaaccaccatggcacacgtacatctgtgtaacaaacctgcacgttctgtacatgtatcctgtttttgttttggttttttagaagaaataaaaacaaacaa

SEQ ID NO: 1017 - DNA, 1034 bp, Artificial Sequence
  Synthetic polypeptide
atggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttttcacacccaacctcttcctgaagcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactggacatggatgaagctggaagtcatcatcctcagcaaactaacacaggaacaggaagccagacactgcatgttccctctcataagtgggagttgaacaatgagaacacatggacaaagggaggggaacaacacacaccagggcctgctgaggggtgaggagtgaggagaagggaacttagaggatgggtcaacaggtgcagcaaaccaccatggcacacgtacatctgtgtaacaaacctgcacgttctgtacatgtatcctgtttttgttttggttttttagaagaaataaaaacaaacaa

SEQ ID NO: 1018 - DNA, 1010 bp, Artificial Sequence
  Synthetic polypeptide
atggccaaagacaactcaactgttcgttgcttccagggcctgctgatttttggaaatgtgattattggttgttgcggcattgccctgactgcggagtgcatcttctttgtatctgaccaacacagcctctacccactgcttgaagccaccgacaacgatgacatctatggggctgcctggatcggcatatttgtgggcatctgcctcttctgcctgtctgttctaggcattgtaggcatcatgaagtccagcaggaaaattcttctggcgtatttcattctgatgtttatagtatatgcctttgaagtggcatcttgtatcacagcagcaacacaacaagactttcagatgctagagaggtaccaaaacaacagccctccaaacaatgatgaccagtggaaaaacaatggagtcaccaaaacctgggacaggctcatgctccaggacaattgctgtggcgtaaatggtccatcagactggcaaaaatacacatctgccttccggactgagaataatgatgctgactatccctggcctcgtcaatgctgtgttatgaacaatcttaaagaacctctcaacctggaggcttgtaaactaggcgtgcctggtttttatcacaatcagggctgctatgaactgatctctggtccaatgaaccgacacgcctggggggttgcctggtttggatttgccattctctgctggactggacatggatgaagctggaagtcatcatcctcagcaaactaacacaggaacaggaagccagacactgcatgttccctctcataagtgggagttgaacaatgagaacacatggacaaagggaggggaacaacacacaccagggcctgctgaggggtgaggagtgaggagaagggaacttagaggatgggtcaacaggtgcagcaaaccaccatggcacacgtacatctgtgtaacaaacctgcacgttctgtacatgtatcctgtttttgttttggttttttagaagaaataaaaacaaacaa

SEQ ID NO: 1019 - DNA, 359 bp, Artificial Sequence
  Synthetic polypeptide
atggcgcttgacggaccagagcaggtatggcgggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1020 - DNA, 590 bp, Artificial Sequence
  Synthetic polypeptide
atggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1021 - DNA, 566 bp, Artificial Sequence
  Synthetic polypeptide
atggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1022 - DNA, 533 bp, Artificial Sequence
  Synthetic polypeptide
atggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1023 - DNA, 154 bp, Artificial Sequence
  Synthetic polypeptide
caacttatgagatgattggtggactggacaaacagatcaaggagatcaaagaagtgatcgagctgcctgttaagcatcctgagctcttcgaagcactgggcattgctcagcccaagcaagggacccagcactcggtaaatgttcactgaatgaa

SEQ ID NO: 1024 - DNA, 211 bp, Artificial Sequence
  Synthetic polypeptide
atgacggaactagagacagccatgggcatgatcatagacgtcttttcccgatattcgggcagcgagggcagcacgcagaccctgaccaagggggagctcaaggtgctgatggagaaggagctaccaggcttcctgcagggcgatgcctctgccgtgtctggtggtgttgaggagttcctgtttgtgtaagcagctagttcagtgccagcac

SEQ ID NO: 1025 - DNA, 1834 bp, Artificial Sequence; identical to SEQ ID NO: 133
  Synthetic polypeptide

SEQ ID NO: 1026 - DNA, 1765 bp, Artificial Sequence; identical to SEQ ID NO: 135
  Synthetic polypeptide

SEQ ID NO: 1027 - DNA, 609 bp, Artificial Sequence; identical to SEQ ID NO: 249
  Synthetic polypeptide

SEQ ID NO: 1028 - DNA, 738 bp, Artificial Sequence; identical to SEQ ID NO: 250
  Synthetic polypeptide

SEQ ID NO: 1029 - DNA, 537 bp, Artificial Sequence; identical to SEQ ID NO: 251
  Synthetic polypeptide

SEQ ID NO: 1030 - DNA, 684 bp, Artificial Sequence; identical to SEQ ID NO: 253
  Synthetic polypeptide

SEQ ID NO: 1031 - DNA, 285 bp, Artificial Sequence; identical to SEQ ID NO: 255
  Synthetic polypeptide

SEQ ID NO: 1032 - DNA, 552 bp, Artificial Sequence; identical to SEQ ID NO: 254
  Synthetic polypeptide

SEQ ID NO: 1033 - DNA, 299 bp, Artificial Sequence
  Synthetic polypeptide
atggctcttcctcagggtctattgacattcagggacgtggccatagaattctctcaggaggagtggaaatgcctggaccctgctcagaggactttatacagggacgtgatgctggagaattataggaacctcgtctccctgggcctctccactgagctctacaatcctgtgtgcagttgtctgctcacctctctgctgggacatcaaacaggcatctccaccttcacatgtccaaaagtgacttcctaaacccccaaacacattcccttgcagtctgcacatctcagatgagggtgact

SEQ ID NO: 1034 - DNA, 191 bp, Artificial Sequence
  Synthetic polypeptide
atgctggagaattataggaacctcgtctccctgggcctctccactgagctctacaatcctgtgtgcagttgtctgctcacctctctgctgggacatcaaacaggcatctccaccttcacatgtccaaaagtgacttcctaaacccccaaacacattcccttgcagtctgcacatctcagatgagggtgact

SEQ ID NO: 1035 - DNA, 965 bp, Artificial Sequence
  Synthetic polypeptide
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1036 - DNA, 725 bp, Artificial Sequence
  Synthetic polypeptide
atgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1037 - DNA, 2161 bp, Artificial Sequence; identical to SEQ ID NO: 288
  Synthetic polypeptide

SEQ ID NO: 1038 - DNA, 2140 bp, Artificial Sequence; identical to SEQ ID NO: 289
  Synthetic polypeptide

SEQ ID NO: 1039 - DNA, 529 bp, Artificial Sequence; identical to SEQ ID NO: 287
  Synthetic polypeptide

SEQ ID NO: 1040 - DNA, 1097 bp, Artificial Sequence
  Synthetic polypeptide
atcattatgaaatacgaaaagggacaccgagctgggctgccagaggacaaggggcctaagccttttcgaagctacaacaacaacgtcgatcatttggggattgtacagtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1041 - DNA, 965 bp, Artificial Sequence
  Synthetic polypeptide
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccaccgtaggattcccattcctaggccattctggaaaaggccaaaccacagggactgagaagcagtctgggtggccaggggctgacggatcggggagaggctgggtgcatagg

SEQ ID NO: 1042 - DNA, 1288 bp, Artificial Sequence
  Synthetic polypeptide
atggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1043 - DNA, 931 bp, Artificial Sequence
  Synthetic polypeptide
atgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1044 - DNA, 850 bp, Artificial Sequence
  Synthetic polypeptide
atgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1045 - DNA, 1954 bp, Artificial Sequence
  Synthetic polypeptide
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1046 - DNA, 1873 bp, Artificial Sequence
  Synthetic polypeptide
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1047 - DNA, 1888 bp, Artificial Sequence
  Synthetic polypeptide
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaagaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgaggtaggaatccagagccagagaggtgatattggtgcagttgttggcagtgctccggccacagctggaggtgcaggctcagaactgggagccacgtattgaggaatgctgac

SEQ ID NO: 1048 - DNA, 1692 bp, Artificial Sequence
  Synthetic polypeptide
atgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaaggcaccctccacttcctaatctacgtcagtactggttaatgttgcctgtccatcctttccacgctcctcccccgagaatgtcagccccttgaagctgcggtctgtctatgctggtcgtaccctcagagcctaaga

SEQ ID NO: 1049 - DNA, 1695 bp, Artificial Sequence
  Synthetic polypeptide
atgtgcgcgcggatggccggtcgcacaacagcggcccctcgggggccctacggcccctggctctgcctcctggtggccctcgccctggacgtcgtgagagtggactgtggccaggctcccctggaccctgtctacctgccggcagccctggagctcctagacgcccctgaacacttccgtgtgcagcaggtgggccactacccacctgccaactcctctctgagctcccgatctgagacctttctgctcctacagccctggcccagggcccagccacttctccgggcctcctacccaccttttgccactcagcaggtggtcccccctcgagtcactgagccccaccaacggccagtcccatgggacgtgcgggccgtttcagtggaagcggctgtgactccagcagagccctacgcccgggttctcttccacctcaaagggcaggattggccaccagggtctggcagcctgccctgtgcccggctccatgccacacaccctgccggcactgctcaccaagcctgccgcttccagccatccctgggcgcctgcgtggtggagctggagcttccctcgcactggttctcacaggcctccaccacacgggccgagctggcctacacgcttgagcctgcagctgagggccctgggggctgtggctccggcgaggagaacgaccctggggagcaggccctcccagtggggggtgtggagctgcgcccagcagaccccccgcagtaccaggaggtacctctggacgaggctgtgactctgcgggtgcctgacatgccagtgcggcccggccagctctttagtgctaccctcctgcttcggcacaacttcacagccagcctcctgaccctgcggatcaaggtgaagaaggggctgcatgtgacagccgcccgcccagcccagcccacactctggactgccaagctggaccgcttcaagggctccaggcaccacaccaccctcatcacctgccaccgtgctgggctcacagagccagattccagcagtccccttgaactgtctgagttcctatgggtggactttgtggtggagaatagcactggtgggggcgtagcggtcactcgccccgtcacgtggcagctggagtacccaggccaggcccctgaagcagagaaggacaaaatggtgtgggaaatcctggtgtctgagcgggacatcagagcccttatcccactggccaaggctgaggagctggtgaatacagcaccactgactggagtgccccagcatgtccccgtgcgccttgtcactgtggacggcgggggggccttggtggaggtgacagagcatgtcggctgcgagtctgccaacacacaggtcctgcaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaaggcaccctccacttcctaatctacgtcagtactggttaatgttgcctgtccatcctttccacgctcctcccccgagaatgtcagccccttgaagctgcggtctgtctatgctggtcgtaccctcagagcctaaga

SEQ ID NO: 1050 - DNA, 466 bp, Artificial Sequence
  Synthetic polypeptide
agcggtcactcgccccgtcacgtggcagctggagtacccaggccaggcccctgaagcagagaaggacaaaatggtgtgggaaatcctggtgtctgagcgggacatcagagcccttatcccactggccaaggtgtctgaggcctgtgatgccgtgttcgtggctggcaaggagagccggggcgcccggggggtgcgagtggacttctggtggcgccggctccgcgcctcgctgcggctgaccgtgtgggcccccctgctaccgctgcgtatcgagctcaccgacaccaccctcgagcaggtccgcggctggagggtacctggccctgctgaaggcaccctccacttcctaatctacgtcagtactggttaatgttgcctgtccatcctttccacgctcctcccccgagaatgtcagccccttgaagctgcggtctgtctatgctggtcgtaccctcagagcctaaga

SEQ ID NO: 1051 - DNA, 569 bp, Artificial Sequence; identical to SEQ ID NO: 426
  Synthetic polypeptide

SEQ ID NO: 1052 - DNA, 258 bp, Artificial Sequence; identical to SEQ ID NO: 265
  Synthetic polypeptide

SEQ ID NO: 1053 - DNA, 243 bp, Artificial Sequence; identical to SEQ ID NO: 267
  Synthetic polypeptide

SEQ ID NO: 1054 - DNA, 324 bp, Artificial Sequence; identical to SEQ ID NO: 268
  Synthetic polypeptide

SEQ ID NO: 1055 - DNA, 615 bp, Artificial Sequence
  Synthetic polypeptide
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttt

SEQ ID NO: 1056 - DNA, 861 bp, Artificial Sequence
  Synthetic polypeptide
atggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagatgaaatggctcaactaggtccatctccaaagcccctgctagcttt

SEQ ID NO: 1057 - DNA, 62 bp, Artificial Sequence
  Synthetic polypeptide
atgtttcggaaaatagatgaaatggctcaactaggtccatctccaaagcccctgctagcttt

SEQ ID NO: 1058 - DNA, 123 bp, Artificial Sequence
  Synthetic polypeptide
atgcttgctgctgggctcttggaggaactaagagattttcacagacgctataatcagaagaatgtttcggaaaatagatgaaatggctcaactaggtccatctccaaagcccctgctagcttt

SEQ ID NO: 1059 - DNA, 1839 bp, Artificial Sequence
  Synthetic polypeptide
atggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatgatcatggatatactaacaatccct

SEQ ID NO: 1060 - DNA, 750 bp, Artificial Sequence
  Synthetic polypeptide
atgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccgctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttc

SEQ ID NO: 1061 - DNA, 296 bp, Artificial Sequence
  Synthetic polypeptide
agctctccgactctgccaagtactacctgaccgacgttgaccgcatcgccaccttgggctacctgcccacccagcaggacgtgctgcgggtccgcgtgcccaccaccggcatcatcgagtaccctttcgacctggagaacatcatcttccgctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttc

SEQ ID NO: 1062 - DNA, 1412 bp, Artificial Sequence
  Synthetic polypeptide
atgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaggaagaggcaccaggagcatgcacacacagggaagaaggacctgtgaggacacagcgagaagacagctgtctgcaagcccaggagagagccctccccagagaccagccctgctgccaccttgatcttggccttccagcttccagaactgtgagaaaattaatttcggtttttgaaggtccccaggctgtggcattttgctatggcagccgtagcagccaagtaca

SEQ ID NO: 1063 - DNA, 1430 bp, Artificial Sequence
  Synthetic polypeptide
atgaaaggcttttcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaggaagaggcaccaggagcatgcacacacagggaagaaggacctgtgaggacacagcgagaagacagctgtctgcaagcccaggagagagccctccccagagaccagccctgctgccaccttgatcttggccttccagcttccagaactgtgagaaaattaatttcggtttttgaaggtccccaggctgtggcattttgctatggcagccgtagcagccaagtaca

SEQ ID NO: 1064 - DNA, 1496 bp, Artificial Sequence
  Synthetic polypeptide
atgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaggaagaggcaccaggagcatgcacacacagggaagaaggacctgtgaggacacagcgagaagacagctgtctgcaagcccaggagagagccctccccagagaccagccctgctgccaccttgatcttggccttccagcttccagaactgtgagaaaattaatttcggtttttgaaggtccccaggctgtggcattttgctatggcagccgtagcagccaagtaca

SEQ ID NO: 1065 - DNA, 2474 bp, Artificial Sequence
  Synthetic polypeptide
atgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1066 - DNA, 1694 bp, Artificial Sequence
  Synthetic polypeptide
atgggcatctccggccaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1067 - DNA, 1361 bp, Artificial Sequence
  Synthetic polypeptide
atgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1068 - DNA, 688 bp, Artificial Sequence
  Synthetic polypeptide
cggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1069 - DNA, 531 bp, Artificial Sequence
  Synthetic polypeptide
caagatgaccacgctcacacccgcgtaccacgccgagaactacagccctgaggacaacaggtttgatctgcgaccatttctgtacaacacaagctggccttggcagtttcggtgcatagaaaatcaggcctctgagcccaagctaagccatcatgtcctctgtaacctgcacgtacacatccagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctcacacaaagcctgtttggtggtctcttcacaccgatgcgagtga

SEQ ID NO: 1070 - DNA, 610 bp, Artificial Sequence; identical to SEQ ID NO: 163
  Synthetic polypeptide

SEQ ID NO: 1071 - DNA, 719 bp, Artificial Sequence; identical to SEQ ID NO: 367
  Synthetic polypeptide

SEQ ID NO: 1072 - DNA, 716 bp, Artificial Sequence; identical to SEQ ID NO: 369
  Synthetic polypeptide

SEQ ID NO: 1073 - DNA, 683 bp, Artificial Sequence; identical to SEQ ID NO: 372
  Synthetic polypeptide

SEQ ID NO: 1074 - DNA, 1736 bp, Artificial Sequence; identical to SEQ ID NO: 156
  Synthetic polypeptide

SEQ ID NO: 1075 - DNA, 1724 bp, Artificial Sequence; identical to SEQ ID NO: 157
  Synthetic polypeptide

SEQ ID NO: 1076 - DNA, 775 bp, Artificial Sequence; identical to SEQ ID NO: 215
  Synthetic polypeptide

SEQ ID NO: 1077 - DNA, 711 bp, Artificial Sequence
  Synthetic polypeptide
atgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggtagaccctgaaaattatgtagttggccct

SEQ ID NO: 1078 - DNA, 414 bp, Artificial Sequence
  Synthetic polypeptide
atgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggtagaccctgaaaattatgtagttggccct

SEQ ID NO: 1079 - DNA, 980 bp, Artificial Sequence; identical to SEQ ID NO: 139
  Synthetic polypeptide

SEQ ID NO: 1080 - DNA, 1256 bp, Artificial Sequence; identical to SEQ ID NO: 140
  Synthetic polypeptide

SEQ ID NO: 1081 - DNA, 1277 bp, Artificial Sequence; identical to SEQ ID NO: 142
  Synthetic polypeptide

SEQ ID NO: 1082 - DNA, 128 bp, Artificial Sequence
  Synthetic polypeptide
atggcctcggcccccgcggaggcggagacccgacagaggctgctacgcaccgtcaagaaggaggtcccttctcaaggtctcactttcctgctttctaagtggacgaggttggacagctccaggattcc

SEQ ID NO: 1083 - DNA, 734 bp, Artificial Sequence
  Synthetic polypeptide
atggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctcaaaaaaaaaaaaaaaa

SEQ ID NO: 1084 - DNA, 593 bp, Artificial Sequence
  Synthetic polypeptide
atgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctcaaaaaaaaaaaaaaaa

SEQ ID NO: 1085 - DNA, 443 bp, Artificial Sequence
  Synthetic polypeptide
tgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggtgtggtggtacatacctgtagtctcagctactcgggagactgagatgggaggatcactgagcccagcaggtcaaggctacagtgagctgtgattgtgattgtgccactgcattccagcctggacaagagagcaagaccctatctcaaaaaaaaaaaaaaaa

SEQ ID NO: 1086 - DNA, 418 bp, Artificial Sequence
  Synthetic polypeptide
atggggccgcatcgtctatggatgtgcctttctgcttgttgtcctgctgtccatgctatgcctggtattggcccattggcccaaacgcctgttctctggagagctgatctacatcgcagcggctgtgttgctgctggtgctcattgtgggattcactttcaccgtctggagacagccccagagcaacactcctctttacttcaaggtccccctgttgcctgttctcctctggtcagcatctctgcacatgtttacctgatgatgcagatgaccactgagacctgggcccaatgtggagtctggatgttgattgtcccagctactcaggagatgaaggcaggagcatcgcttgagaccaggagctccagaccagcctgggcaacatggcgagactccacctctaccaaaataaaaaact

SEQ ID NO: 1087 - DNA, 606 bp, Artificial Sequence
  Synthetic polypeptide
atgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagagcacccagcaccgtgtagaatcttcataagtgttagct

SEQ ID NO: 1088 - DNA, 663 bp, Artificial Sequence
  Synthetic polypeptide
atgcccatgatactggggtactgggacatccgcgggctggcccacgccatccgcctgctcctggaatacacagactcaagctatgaggaaaagaagtacacgatgggggacgctcctgattatgacagaagccagtggctgaatgaaaaattcaagctgggcctggactttcccaatgggatgctggggagcctggtggcccaactgagcttcgccggtttcccatccatccagctgccctacttgattgatggggctcacaagatcacccagagcaacgccatcttgtgctacattgcccgcaagcacaacctgtgtggggagacagaagaggagaagattcgtgtggacattttggagaaccagaccatggacaaccatatgcagctgggcatgatctgctacaatccagaatttgagaaactgaagccaaagtacttggaggaactccctgaaaagctaaagctctactcagagtttctggggaagcggccatggtttgcaggaaacaagatcacttttgtagattttctcgtctatgatgtccttgacctccaccgtatatttgagcccaagtgcttggacgccttcccaaatctgaaggacttcatctcccgctttgagagcacccagcaccgtgtagaatcttcataagtgttagct

SEQ ID NO: 1089 - DNA, 1098 bp, Artificial Sequence
  Synthetic polypeptide
atgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgaggtgacctgcagctgccctttgcccgactccagcagctcctccgactc

SEQ ID NO: 1090 - DNA, 766 bp, Artificial Sequence
  Synthetic polypeptide
atgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctgcatgcccccatcctgtgccgataagaactccagaccccaaactcagctcatacacacacggaagagagaagcatctgaacatcaagaagagaagaagctgctggacatcagaaactgtgaaaggagaggagtttggctgagctccaggggaagactgcctgcacattctatccccttttcagttccccatcctgctgtcagccacatttaccactcaataaaatcttcacattcaccatccttcaagtccgtgtgacctcattcctcttgggcactggacaaggacccagttgcgggtgcagtaggctgtcacactgactctccactgagctgtttaacacttaagttgtctgtagacagcaaagctaaaacagcacactgtaacacatgccctctggggctctagaggctgtggacagcccctagacgctgctgtgggctggtaaggagtttattcctgctggtgcccaaaggcactcaccccagctcctgcacccactcacctacatcttccccctctttcaaggggtttgagcactgcaggctgagtaagcgagccagcgcttcacaagccccatggggtcaagggaacccatctca

SEQ ID NO: 1091 - DNA, 890 bp, Artificial Sequence; identical to SEQ ID NO: 319
  Synthetic polypeptide

SEQ ID NO: 1092 - DNA, 947 bp, Artificial Sequence; identical to SEQ ID NO: 320
  Synthetic polypeptide

SEQ ID NO: 1093 - DNA, 1213 bp, Artificial Sequence
  Synthetic polypeptide
atgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccactggaagctcctcaaggccaggatcacctcggaagcacatctgagtcttgggtccaggacaaggcttggcagagaggaggcccctaggacaggtttg

SEQ ID NO: 1094 - DNA, 616 bp, Artificial Sequence
  Synthetic polypeptide
atgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccactggaagctcctcaaggccaggatcacctcggaagcacatctgagtcttgggtccaggacaaggcttggcagagaggaggcccctaggacaggtttg

SEQ ID NO: 1095 - DNA, 868 bp, Artificial Sequence
  Synthetic polypeptide
atgaagaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccactggaagctcctcaaggccaggatcacctcggaagcacatctgagtcttgggtccaggacaaggcttggcagagaggaggcccctaggacaggtttg

SEQ ID NO: 1096 - DNA, 506 bp, Artificial Sequence
  Synthetic polypeptide
atgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtattcaagaagccc

SEQ ID NO: 1097 - DNA, 3220 bp, Artificial Sequence; identical to SEQ ID NO: 248
  Synthetic polypeptide

SEQ ID NO: 1098 - DNA, 533 bp, Artificial Sequence
  Synthetic polypeptide
atggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagagcaggaccaaccctcccttcctcctcctcagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactg

SEQ ID NO: 1099 - DNA, 1029 bp, Artificial Sequence
  Synthetic polypeptide
atgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagcctggtgacagagtaagactccatctcgaacaacaaaaaaaaaagaa

SEQ ID NO: 1100 - DNA, 591 bp, Artificial Sequence
  Synthetic polypeptide
atggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagcctggtgacagagtaagactccatctcgaacaacaaaaaaaaaagaa

SEQ ID NO: 1101 - DNA, 1352 bp, Artificial Sequence
  Synthetic polypeptide
atgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtgggtcctagctggtgcattaaaacaagaaataagagatacaagaatcagaagaggagaaaccaaactgtcattgttttcagatgatatggttgtacctataaaacaccaaaacttttatagtcaaattaagaattaataagctagcttaccaacttgctcaatcaataaacaaaaattcaattgctcaattgctttttgaactctgggaaaccgaaaatgaacaaaaatttccattttctatggcatcaaaaaaataacaatactaacaatacagtgagcaaaaattatgcaaga

SEQ ID NO: 1102 - DNA, 1589 bp, Artificial Sequence
  Synthetic polypeptide
atgaggagggagagaactaggggcccgcaggcctgggaatttccgtcccccaccaagtccggatgctcactccaaagtctcagcagggacctgagggagctcagggagggagagaagccagaagaccaggcagagactgaagagagctggcaaggcctggctagaaaaactccaggcaaggcctgtgcccctgagggagggagctgtcagccagggaaaaccgagaacaccatcaccatgacaaccagtcaccagcctcaggacagatacaaagctgtctggcttatcttcttcatgctgggtctgggaacgctgctcccgtggaattttttcatgacggccactcagtatttcacaaaccgcctggacatgtcccagaatgtgtccttggtcactgctgaactgagcaaggacgcccaggcgtcagccgcccctgcagcacccttgcctgagcggaactctctcagtgccatcttcaacaatgtcatgaccctatgtgccatgctgcccctgctgttattcacctacctcaactccttcctgcatcagaggatcccccagtccgtacggatcctgggcagcctggtggccatcctgctggtgtttctgatcactgccatcctggtgaaggtgcagctggatgctctgcccttctttgtcatcaccatgatcaagatcgtgctcattaattcatttggtgccatcctgcagggcagcctgtttggtctggctggccttctgcctgccagctacacggcccccatcatgagtggccagggcctagcaggcttctttgcctccgtggccatgatctgcgctattgccagtggctcggagctatcagaaagtgccttcggctactttatcacagcctgtgctgttatcattttgaccatcatctgttacctgggcctgccccgcctggaattctaccgctactaccagcagctcaagcttgaaggacccggggagcaggagaccaagttggacctcattagcaaaggagaggagccaagagcaggcaaagaggaatctggagtttcagtctccaactctcagcccaccaatgaaagccactctatcaaagccatcctgaaaaatatctcagtcctggctttctctgtctgcttcatcttcactatcaccattgggatgtttccagccgtgactgttgaggtcaagtccagcatcgcaggcagcagcacctgggaacgttacttcattcctgtgtcctgtttcttgactttcaatatctttgactggttgggccggagcctcacagctgtattcatgtgggtcctagctggtgcattaaaacaagaaataagagatacaagaatcagaagaggagaaaccaaactgtcattgttttcagatgatatggttgtacctataaaacaccaaaacttttatagtcaaattaagaattaataagctagcttaccaacttgctcaatcaataaacaaaaattcaattgctcaattgctttttgaactctgggaaaccgaaaatgaacaaaaatttccattttctatggcatcaaaaaaataacaatactaacaatacagtgagcaaaaattatgcaaga

SEQ ID NO: 1103 - DNA, 2380 bp, Artificial Sequence
  Synthetic polypeptide
atggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1104 - DNA, 2503 bp, Artificial Sequence
  Synthetic polypeptide
atggccatgagatccgggaggcacccctcgctgctgctgcttctagtgctgctgctgtggctgctgcaggtcagtatcattgacagtgttcaacaggaaacagatgatcttactaagcaaacaaaggaaaagatctaccagcctctacggcgatccaagagaagatgggttatcaccaccttggagctggaggaggaagacccgggaccctttcccaaactcattggtgagctgttcaataatatgtcttataacatgtcactaatgtatctaatcagtggacctggtgtggatgaatatccagagattggtttgttttctctagaagatcatgagaacggaaggatatatgttcaccgccctgtcgatcgagaaatgacaccatctttcacggtttattttgatgttgtggagcgctcaacaggaaaaattgtggatacatccttgattttcaacattaggatcagtgatgtgaatgatcatgcaccccagtttccagagaaggaatttaacatcactgtgcaagaaaaccaatctgcagggcaacctatttttcagatgttagcagtcgatttggatgaagaaaacactccaaattctcaagtcctttacttcctcatttctcaaacaccattactgaaagaaagtggtttccgggttgatcgccttagtggagaaatacgactctctggctgcttagattatgagaccgctcctcagtttacactgctaatcagagccagggactgtggagaaccgtcactgtcatccacgaccaccgttcacgtggatgtgcaagaaggcaacaaccacaggcctgcatttacccaggagaactataaggttcagattcctgaaggccgagccagccagggcgtgttgcgtctcctggttcaagatcgagattctccatttacatcagcttggagagcaaaattcaacatattgcatggcaatgaagaggggcattttgacatttcgactgaccctgagaccaacgaagggatattaaatgttatcaagcctttggattatgagactcgcccagcgcaaagcctcatcattgtcgtggagaatgaggagaggctcgtcttctgtgagagaggaaagcttcagccgccaaggaaggcagcagccagcgccactgtgagtgtgcaggtgacagacgccaacgacccaccagcctttcacccccagagcttcattgtcaataaagaggagggcgccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1105 - DNA, 1155 bp, Artificial Sequence
  Synthetic polypeptide
ccaggcctgggaccctgttgggaacttttaatgccatggatccagacagccagataagatatgaactggttcatgacccagcaaattgggtcagcgtcgacaaaaactccggagtggtcatcaccgtggagccaattgaccgagaatcccctcatgtaaataacagtttttatgtaatcatcattcacgctgttgatgatggcttcccaccgcagactgctacagggaccctaatgctcttcctgtctgacatcaatgacaacgtcccgactctccggccacgttcccgctacatggaggtctgtgagtctgctgtgcatgagcccctccacatcgaggcagaggatccggacctggagccgttctctgacccatttacatttgaattggacaatacctggggaaatgcggaggacacatggaagttggggagaaattggggtcaatcagttgaacttttaaccttgagaagcctgccacgtggtaattacttggtgccactcttcattggagacaaacagggactttcccagaagcaaactgtccatgtaaggatctgcccctgtgccagtgggctcacatgtgtggagcttgcagatgcagaagtggggcttcatgtgggggccctgttccctgtctgtgcagcatttgtggctctggcagtggctctgctttttctgttgcgatgctattttgtgcttgaacctaagaggcatggatgctctgtatccaatgatgaaggccaccaaacactggtcatgtataatgcggagagcaaaggcacttcagcccagacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1106 - DNA, 379 bp, Artificial Sequence
  Synthetic polypeptide
atgaaacctctgatatggacatggtcagatgttgaaggccagaggccggctctgctcatctgcacagctgcagcaggacccacgcagggagttaaggcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1107 - DNA, 502 bp, Artificial Sequence
  Synthetic polypeptide
atgaaacctctgatatggacatggtcagatgttgaaggccagaggccggctctgctcatctgcacagctgcagcaggacccacgcagggagttaaggatctcgaggaagtgcctccatctgcagcgagtcagtcagcccaagcacgctgtgctctggggagctggggttatggcaagccctttgagccaagaagtgtgaaaaacatacactctactcctgcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1108 - DNA, 433 bp, Artificial Sequence
  Synthetic polypeptide
atgaaacctctgatatggacatggtcagatgttgaaggccagaggccggctctgctcatctgcacagctgcagcaggacccacgcagggagttaagggttatggcaagccctttgagccaagaagtgtgaaaaacatacactctactcctgcttacccagatgccacaatgcacagacaactcctggctccggtggaaggaaggatggcagagacattgaatcaggctggctgccgacctgaagggggactatctgcagagcttgggaagggaggcatccacagtggaatcctgtgttggaaggagccagagtccctcacactggcaggccaaaaaggcctggatccccaaacttttacaaaagagaaataaatgtaagtcagcatttgtgggggcactgtgttctgtcattcatcgtcgaacttaatactaa

SEQ ID NO: 1109 - DNA, 951 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 1110 - DNA, 1036 bp, Artificial Sequence
  Synthetic polypeptide
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 1111 - DNA, 871 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttcttcatagcagtgtgaaaacagactaat

SEQ ID NO: 1112 - DNA, 577 bp, Artificial Sequence
  Synthetic polypeptide
atggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagactgcctggaaggctgaagtcccagctgctcggaaggctgaagtgagaagattgagtctgggaagtcaaggctgcaatgagctgtgatcatgccactgcactccaacctgggcgacagagcaagaccttgtctcaaaaataaa

SEQ ID NO: 1113 - DNA, 252 bp, Artificial Sequence
  Synthetic polypeptide
cattttttcatcggttatatgatgaagatattgtacgagacagtggacatattgttaaatgtttagattctttttgtgatccatttctcatttctgatgagttacgaagactgcctggaaggctgaagtcccagctgctcggaaggctgaagtgagaagattgagtctgggaagtcaaggctgcaatgagctgtgatcatgccactgcactccaacctgggcgacagagcaagaccttgtctcaaaaataaa

SEQ ID NO: 1114 - DNA, 763 bp, Artificial Sequence; identical to SEQ ID NO: 261
  Synthetic polypeptide

SEQ ID NO: 1115 - DNA, 646 bp, Artificial Sequence; identical to SEQ ID NO: 262
  Synthetic polypeptide

SEQ ID NO: 1116 - DNA, 224 bp, Artificial Sequence
  Synthetic polypeptide
atggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagaa

SEQ ID NO: 1117 - DNA, 6132 bp, Artificial Sequence
  Synthetic polypeptide
atgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccagatgcagctgttctcttagttacattggcagattgtgtgttgtcaatgttgactattgcttagggaaccacagtatatcagtgcatggcctctgcctggccctttcgcacaattgtaactgtagcggtctgcaaagatatgaaaggaacatctgtgagatagatactgaagactgcaaatctgcgtcctgcaaaaatggaacaactagtacacatttaaggggatatttcttccgcaagtgtgtcccaggatttaaaggtacgcaatgtgaaattgatatagatgagtgtgcttcacatccctgcaaaaatggagccacctgcattgaccaacctggtaattacttctgccagtgtgtgcctccatttaaagtggttgatggcttttcctgcttatgcaatccaggctatgttgggataagatgtgaacaggacattgatgactgcatcctgaatgcctgtgagcacaattctacctgcaaagacctgcatctcagctaccagtgtgtgtgcctatctgattgggaaggaaatttttgtgaacaagaatccaatgagtgtaaaatgaatccttgcaagaacaattccacctgtactgacctttacaaaagctatcgatgtgagtgtacatctggatggactggacagaactgtagtgaagaaataaatgaatgcgactctgatccatgcatgaatggaggtctttgtcatgaatctaccatccctggacaatttgtatgtctgtgcccacccctttatactggacaattttgccaccaacgctataacctttgtgacctacttcataacccttgcagaaacaactcaacatgcttagctttggtagacgcaaatcagcattgtatttgtagagaagaatttgaaggtaaaaactgtgaaattgatgtgaaagactgcctcttcctttcctgccaggattatggtgactgtgaagatatggtcaacaatttcaggtgtatttgcagacctgggttttctggatctctgtgtgaaattgaaattaatgaatgttcctctgaaccttgcaaaaataatggaacatgtgtggatctgacaaacagatttttttgtaattgtgaacctgagtaccatgggcccttctgtgaacttgatgtaaataaatgtaaaatctcaccttgtctagatgaagaaaattgtgtctacaggactgatggatacaactgcctctgtgcccctggttatacaggcatcaactgtgaaataaatctagatgaatgcctatcagagccctgtctccatgatggagtttgtatcgatggcatcaatcattatacctgtgactgcaagagtgggttttttggaacacactgtgaaacaaacgccaatgattgcctttcaaatccttgtctacatggaaggtgcacagaacttattaatgaatatccatgttcatgtgatgcagatgggactagcacacaatgtaagatcaaaattaatgactgcacatcaatcccttgtatgaatgaaggcttctgtcagaagtcagcacatggatttacttgcatttgcccacgtggatacactggtgcatactgtgaaaaaagcattgataattgtgctgagcctgaacttaattcagtcatctgtcttaatggagggatctgtgttgatgggcctggacatacttttgactgcagatgtcttcctggattttctggtcaattttgtgaaattaatataaatgaatgctcttcatcaccatgtctacatggtgcagactgtgaagatcacatcaatggatatgtttgcaaatgccaaccaggatggtctggacaccactgtgagaatgagcttgagtgcattcccaactcatgtgttcatgaactctgcatggagaatgaacctggctcgacatgtttatgcacacctggatttatgacctgctccattgggcttctttgtggtgatgaaataaggagaattacctgtttaactcccatctttcaaagaacagatcccatttccacacagacatatacaattcccccttctgagactttggtcagcagctttccatctataaaggctactagaataccagccataatggacacttacccagttgatcaaggtccaaaacagacaggcattgtcaagcacgacattctcccaaccactggtttggcaacattaagaattagcacacccttggaaagctacttactccaagaactgattgtcactagagagctttcagcaaaacacagtcttctttcttccgcagatgtttcctcttctcgattcctgaattttggtattcgtgacccagcacaaattgtccaggacaaaacatcggtatcacatatgcctattcgaacttcagcagccacactaggtttcttttttcctgataggagagcaaggaccccatttatcatgtcttccttaatgtcagattttatttttcctacacaatctttattatttgagaactgtcagactgttgctttatctgctaccccaacgacttcagtaattagaagcattccaggggctgatattgagctaaacaggcagtcattactctcccgtggattcctgcttatagctgcctccataagtgcaactccagttgtctctaggggggctcaagaggatattgaagaatattcagctgattctttaatttcaagaagagagcactggagattgctcagcccctcgatgtctcccatttttcctgctaaggtaattatatctaaacaggtaaccatcttaaactcatcagctctgcaccggttcagtacaaaagccttcaatcccagtgaatatcaggctattactgaggcttcaagcaaccagagactcacaaacatcaaatcacaggctgctgattctttaagagaattaagccaaacatgtgcaacatgttctatgactgaaataaaatcctctcgtgaattctcagatcaagttttgcatagcaaacagtcccacttttatgagacattctggatgaactcagcgatattagccagctggtatgcactaatgggagctcaaactatcacttctgggcattcattttcttctgctactgaaataacaccatcagtggcattcacagaagtgccatctttatttccttctaaaaagagtgcaaaaagaacaattttatcctcatccttggaagaatccattaccctatcaagtaatttggatgttaatttatgtttggataagacttgtttatccattgtcccttcacaaactatctcttcagacttgatgaattctgatttgacttcaaaaatgactactgatgaactgtcagtatcagaaaacattttaaaactattgaaaataagacaatatggcataactatgggacccactgaggtactaaatcaagagagcttattggacatggaaaaaagtaaaggatctcatacactgttcaaacttcacccaagtgatagttctctggattttgagttaaacttacaaatttatccggatgttactttaaagacatattcagaaattacacatgcaaatgacttcaaaaataatctgccaccattgacaggctcagtgcctgatttttcagaagtcaccaccaatgttgcattttatacagtttcagcaactccagcactttcaatacagacgtcttcctccatgtctgtaattaggccagattggccatattttacagattatatgacctctcttaaaaaagaggtcaagacttcttcagaatggtccaaatgggaacttcagcctagtgtgcaatatcaggaatttcccactgcaagccggcatcttcccttcactagatctcttactttgtcttcactggaatccattctggcacctcaacggctgatgatttctgatttcagttgtgttcgttattatggagattcttatctagaatttcagaatgtggctttaaatccacaaaataacatctccctagaatttcagaccttcagctcctatggacttctgctgtatgtcaagcaagactcaaatttagtagatggattttttattcaattgtttattgaaaatggtactttaaagtaccacttttactgtcctggtgaagcaaaatttaaaagcattaatactactgttagagtggacaacgggcaaaagtatacactgcttatcaggcaagaattggatccatgtaacgctgagctgactattttagggaggaatacacaaatatgcgaatctatcaatcatgtactcggaaaacccctgccaaaatcaggatctgtcttcattggtggatttccagaccttcatgggaaaatccaggcaaggacagttcctgtcacattgttggagttcaatgaacagcttttaaataaa

SEQ ID NO: 1118 - DNA, 1394 bp, Artificial Sequence
  Synthetic polypeptide
atgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1119 - DNA, 1625 bp, Artificial Sequence
  Synthetic polypeptide
atgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1120 - DNA, 1505 bp, Artificial Sequence
  Synthetic polypeptide
atggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1121 - DNA, 1562 bp, Artificial Sequence
  Synthetic polypeptide
atggacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1122 - DNA, 1601 bp, Artificial Sequence
  Synthetic polypeptide
atggggacaggacccggtgtctccggacgcctagcagcctccaggccgggcccggggctgcccctccgggactcggagccctcctgggccgggggtcgtgcccgcgacggtgatagccaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1123 - DNA, 1631 bp, Artificial Sequence
  Synthetic polypeptide
atgagtcttggggaacgggggtcgccccagaccttcgggggctcctctgtctctaaagggagcgatgcagggcacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatggaaacagggatcataagcttgctgcccccttggggtggtcgcccaagtgcagtaaggaagcgcttgcgcagcgcctggcgcgggccggcccgcagggagcgcgcggtaaccgg

SEQ ID NO: 1124 - DNA, 2151 bp, Artificial Sequence; identical to SEQ ID NO: 127
  Synthetic polypeptide

SEQ ID NO: 1125 - DNA, 1833 bp, Artificial Sequence; identical to SEQ ID NO: 126
  Synthetic polypeptide

SEQ ID NO: 1126 - DNA, 503 bp, Artificial Sequence; identical to SEQ ID NO: 322
  Synthetic polypeptide

SEQ ID NO: 1127 - DNA, 951 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggtgaagttcctcctgatggacaccaggggctcacccagggctgagaccaagtggtcagaccccatcactctccaccaagggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 1128 - DNA, 1036 bp, Artificial Sequence
  Synthetic polypeptide
atggggctaccctgggggcagcctcacctagggctgcagatgctcctcctggcgttgaactgtctccggcccagcctgagcctgggtgagtgggggtcctggatggacgcgtccagccagacccaaggggctgggggccctgctggagtgattggaccctgggcgcccgcccccctccgattgggagaggcagccccagggacccccacgcccgtctccgtggctcaccttttgtcccccgtggccacagagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 1129 - DNA, 871 bp, Artificial Sequence
  Synthetic polypeptide
atggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctactcttggccttcttggcagcctctaccatgcgcttctccagcctgtggtggccggaggaggccccggagcagctgcggatcggctccttcatgggcaagcgctacatgacccaccacatcccacccagagaggccgccacactgccgaaacgtgcctgcttccccttcgccttctgccgtgattgtcagcttcttgagggctccccagccatgcttcctgtacagcctgcaaaactgtgagtcaattaaacctcttttcttcataaattccccagtttccagtagttctttatagcagtgtgaaaacagactaat

SEQ ID NO: 1130 - DNA, 473 bp, Artificial Sequence
  Synthetic polypeptide
atggcggacggcgtggaccacatagacatttacgcggatgtcggcgaagagttcaaccaggaagctgaatatgagagagaagcagagaacgagagaggcaccgggatcgtgaccgagaccgtgaccgagagcgtgaccgagagcgcgaatatcgtcatcgttagaaggttaggtatcgtcatgtgtctgagccgttgtgtgggccatttcccctgcctggaatgctggagatagctgcctgagaagaatctcagtgaggtttgtttttaccattctattgaatggaaactgctacctcccttaattgctttattctttactcttcccatgcatttatgacctagcactatgtattttgcttgttcgttcaaatataaagtcccatgaaagcaaggatcttattgtagtttctgttaaatcccaagtgtctacatcagcttgtggcaagcaaatgttaatatttgaatgaagga

SEQ ID NO: 1131 - DNA, 1035 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1132 - DNA, 996 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1133 - DNA, 1047 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1134 - DNA, 1137 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1135 - DNA, 1005 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1136 - DNA, 1140 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1137 - DNA, 1128 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1138 - DNA, 1125 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1139 - DNA, 1008 bp, Artificial Sequence
  Synthetic polypeptide
atggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1140 - DNA, 943 bp, Artificial Sequence
  Synthetic polypeptide
gcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcagttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1141 - DNA, 660 bp, Artificial Sequence
  Synthetic polypeptide
agtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1142 - DNA, 593 bp, Artificial Sequence
  Synthetic polypeptide
tgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatggccaggttcggtggcttatacctgtaatcccagcactttgggaggccaaggtgggtggatcacaaggtcaagagattgagaccatcctggccaacatggtgaaaccccgtctctactaaaaatacaaaaattggctgggcatggtggcatgcgcctgtagtcctgctgaggcaggtgaattgctcaaatccaggaggctgaggttgcacagtgagccaagatcaggccactgcactccagcctgg

SEQ ID NO: 1143 - DNA, 7808 bp, Artificial Sequence
  Synthetic polypeptide
atgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagtccaccagggatcctggcaggctgcaagtggtgcctcgaacagcaacagaatctggtgctttaca

SEQ ID NO: 1144 - DNA, 1874 bp, Artificial Sequence
  Synthetic polypeptide
acagatgtgactactgaagaaatgaaacaagaagaaaatttgagtgtaccgtttgaaatgaccacaagtgaacatatccaagatgaaccaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagtccaccagggatcctggcaggctgcaagtggtgcctcgaacagcaacagaatctggtgctttaca

SEQ ID NO: 1145 - DNA, 53 bp, Artificial Sequence
  Synthetic polypeptide
atgggtcgcaggaacagtcttctcaactagactgaactccttaagtgcaagaa

SEQ ID NO: 1146 - DNA, 183 bp, Artificial Sequence
  Synthetic polypeptide
atgaatggacggtctttgattggcggcgctggtgacgcccgtcatggtcctgtttggaaggacccttttggaactaaagctggtgacgcagcgcgcagaggcatcgcccggctaagcttggccctggcagatgggtcgcaggaacagtcttctcaactagactgaactccttaagtgcaagaa

SEQ ID NO: 1147 - DNA, 163 bp, Artificial Sequence; identical to SEQ ID NO: 351
  Synthetic polypeptide

SEQ ID NO: 1148 - DNA, 222 bp, Artificial Sequence; identical to SEQ ID NO: 355
  Synthetic polypeptide

SEQ ID NO: 1149 - DNA, 721 bp, Artificial Sequence; identical to SEQ ID NO: 414
  Synthetic polypeptide

SEQ ID NO: 1150 - DNA, 3934 bp, Artificial Sequence
  Synthetic polypeptide
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1151 - DNA, 3787 bp, Artificial Sequence
  Synthetic polypeptide
atggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccaaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1152 - DNA, 867 bp, Artificial Sequence
  Synthetic polypeptide
cacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1153 - DNA, 996 bp, Artificial Sequence
  Synthetic polypeptide
gtatcaacgtgaccgtgggtggtgagagctgccagcacgagttccggggggacatggttgtctgccccctgcccccatccctgcagcttggccaggatggtgccccattgcaggtctgcgtagatgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcagcatggagtacctggcagagcagaagtttgtgcacagggacctggctgcgcggaactgcatgcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaa

SEQ ID NO: 1154 - DNA, 1194 bp, Artificial Sequence
  Synthetic polypeptide
atgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccataggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggaaagtttaccaaccc

SEQ ID NO: 1155 - DNA, 1705 bp, Artificial Sequence
  Synthetic polypeptide
atgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggatgttttgaataatttgggatcttgtgaactggatgaagatgatctaatgcttgatcttgaatttttagaggaacagagtcttcacccttctgaactaccgcaggaacataccaggaaagccaagagaatccacagacctttgaaggaattggatcaccgccacaggctccctgagatggcaaaaaactgtgagt

SEQ ID NO: 1156 - DNA, 1111 bp, Artificial Sequence
  Synthetic polypeptide
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1157 - DNA, 1138 bp, Artificial Sequence
  Synthetic polypeptide
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1158 - DNA, 1345 bp, Artificial Sequence
  Synthetic polypeptide
atggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1159 - DNA, 1249 bp, Artificial Sequence
  Synthetic polypeptide
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggaataatattggccttgcagggttgttgtgattactcaggaaagcaagactagtcaagcactttgcacagggcctggcacatagtagatgctcaacaaatactgctgtgtt

SEQ ID NO: 1160 - DNA, 3628 bp, Artificial Sequence; identical to SEQ ID NO: 330
  Synthetic polypeptide

SEQ ID NO: 1161 - DNA, 3127 bp, Artificial Sequence; identical to SEQ ID NO: 332
  Synthetic polypeptide

SEQ ID NO: 1162 - DNA, 3881 bp, Artificial Sequence
  Synthetic polypeptide
atggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagcctggcgactgagtgacactccgtctcaaaaaacaaagaaacaa

SEQ ID NO: 1163 - DNA, 3722 bp, Artificial Sequence
  Synthetic polypeptide
gggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagcctggcgactgagtgacactccgtctcaaaaaacaaagaaacaa

SEQ ID NO: 1164 - DNA, 2501 bp, Artificial Sequence
  Synthetic polypeptide
atggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1165 - DNA, 2552 bp, Artificial Sequence
  Synthetic polypeptide
atggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgcctctccgcagctcagcacagggcagcgacatcccagctcgaaggccgggtggtgagacgggtgctcactgtggcctcgcgtgctctgtgtcccacaggagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1166 - DNA, 2456 bp, Artificial Sequence
  Synthetic polypeptide
atggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1167 - DNA, 588 bp, Artificial Sequence
  Synthetic polypeptide
tccggcccctgcggaagcaggtggagctgctcttcaacacacgatacggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgagcaggggctccagaccccagggatgtggcagagctgccaacttcctgtgtgactccagcaagtcaggcttgcctacctgggcctcagtttccctacttgtaaaatgagaagaattgcccacgccacgtctgcctc

SEQ ID NO: 1168 - DNA, 586 bp, Artificial Sequence; identical to SEQ ID NO: 401
  Synthetic polypeptide

SEQ ID NO: 1169 - DNA, 829 bp, Artificial Sequence; identical to SEQ ID NO: 402
  Synthetic polypeptide

SEQ ID NO: 1170 - DNA, 1060 bp, Artificial Sequence; identical to SEQ ID NO: 403
  Synthetic polypeptide

SEQ ID NO: 1171 - DNA, 730 bp, Artificial Sequence; identical to SEQ ID NO: 406
  Synthetic polypeptide

SEQ ID NO: 1172 - DNA, 496 bp, Artificial Sequence; identical to SEQ ID NO: 408
  Synthetic polypeptide

SEQ ID NO: 1173 - DNA, 321 bp, Artificial Sequence
  Synthetic polypeptide
atgcccatggcggggcttctaaaggggcttgtacggcaactggagcggttcagcgttcaacaacaagcttccaagatgccgcccaaaggaaaaagtggttctggaaaagcggggaaaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaa

SEQ ID NO: 1174 - DNA, 267 bp, Artificial Sequence
  Synthetic polypeptide
gttcaacaacaagcttccaagatgccgcccaaaggaaaaagtggttctggaaaagcggggaaaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaa

SEQ ID NO: 1175 - DNA, 238 bp, Artificial Sequence
  Synthetic polypeptide
caaaggaaaaagtggttctggaaaagcggggaaaggaaaccttccctggctggctccagtgtccctctgtgcttccacagccccctgtccataaccatctctgcatctcctgcattctcctgaaatgatccgtcttcctcactagaatatgagttttctgaaggaaggtacatggcttgttcatctttgtactcccagtgcctggaactcagtagttgtataggaaatgtttattgaa

SEQ ID NO: 1176 - DNA, 639 bp, Artificial Sequence
  Synthetic polypeptide
atgagcatatcatcagccttggccatggttttcatgggggcaaagggaaacactgcagctcagatgtctcaggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccacaacacgtgtaaactcctgggttgctgataaaactaaagcctggaaaattattcaaacaagcctgtcacatctggaggagccaggaatcgcctcttcctcttgttactgcaaagcctgccttccacagcccctactggttcactctattcccaaatgcaactctcctgtgaccccgcatggcatgtggtgacctccctccctgtgagcagttgtgactaataaactgccgccaatttcatctgtccagtgtgtcatgccatgtgtctagttatctcctactatttaatgggggagatccctccttcaccaacaaggtgaatatgagacaatcaaaaca

SEQ ID NO: 1177 - DNA, 2869 bp, Artificial Sequence
  Synthetic polypeptide
atggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagatgtgaccatctagttgcaggaaaacaagctcagggctgtcactgattccacattgtggtgagttgtataattattttattatatatcacaatgtaatagaaataaagtacacaataaatgtaatacacttgaatcatccctaaaccatcgcccccacccccaggtcagtggaaaaatggtcttccatgaaaccagttcctggtgccaaaaagtgtggggactgctg

SEQ ID NO: 1178 - DNA, 340 bp, Artificial Sequence
  Synthetic polypeptide
atggctcttcctcagggtctattgacattcagggacgtggccatagaattctctcaggaggagtggaaatgcctggaccctgctcagaggactttatacagggacgtgatgctggagaattataggaacctcgtctccctgggcctctccactgagctctacaatcctgtgtccagttgtctcctcagctctctgctgggacatcaaacaggcatctccaccttcacgtgtccataagtgacttcctaaacccccaaacacattcccttgcagtcctacacgtctcagatgagggtgactgtgtacttctggggacttagccaaacttgacagcatgttt

SEQ ID NO: 1179 - DNA, 232 bp, Artificial Sequence
  Synthetic polypeptide
atgctggagaattataggaacctcgtctccctgggcctctccactgagctctacaatcctgtgtccagttgtctcctcagctctctgctgggacatcaaacaggcatctccaccttcacgtgtccataagtgacttcctaaacccccaaacacattcccttgcagtcctacacgtctcagatgagggtgactgtgtacttctggggacttagccaaacttgacagcatgttt

SEQ ID NO: 1180 - DNA, 417 bp, Artificial Sequence
  Synthetic polypeptide
atggctcttcctcagggtctattgacattcagggacgtggccatagaattctctcaggaggagtggaaatgcctggaccctgctcagaggactttatacagggacgtgatgctggagaattataggaacctcgtctccctggagttttggtctgtcatcccggctaaagtacagtggtgtcatctccgctcactgcaacctccacttcccaggttcaagcaattctcctgcctcagccttccaagtacctgggactacaggcctctccactgagctctacaatcctgtgtgcagttgtctgctcacctctctgctgggacatcaaacaggcatctccaccttcacatgtccaaaagtgacttcctaaacccccaaacacattcccttgcagtctgcacatctcagatgagggtgact

SEQ ID NO: 1181 - DNA, 715 bp, Artificial Sequence
  Synthetic polypeptide
atggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1182 - DNA, 589 bp, Artificial Sequence
  Synthetic polypeptide
atggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1183 - DNA, 352 bp, Artificial Sequence
  Synthetic polypeptide
atgtcttctctcccagctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1184 - DNA, 180 bp, Artificial Sequence
  Synthetic polypeptide
agatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1185 - DNA, 226 bp, Artificial Sequence
  Synthetic polypeptide
atggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1186 - DNA, 280 bp, Artificial Sequence
  Synthetic polypeptide
atgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagcttgaatatcagcaaatataacctacataaacagaaagctctttgagggtctgcagtaacgttttaagaagaatataaaagaatcctgagaccaaaaatttgagacctgct

SEQ ID NO: 1187 - DNA, 712 bp, Artificial Sequence
  Synthetic polypeptide
atggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggacaatgaaggccaaacagctctacattatgctataataatgaaggcag

SEQ ID NO: 1188 - DNA, 372 bp, Artificial Sequence
  Synthetic polypeptide
atggaagatgcactctttctgcggaccctgcacttgatggatcagctggcaccaccgactaataaactggcttatctgatgttgtggcctccactcaggaactgactgaaggcaggaagacagcttcaactccctgtgatttcacccctgaccaatcaccacacctggctcactggctaccccccaactcccacccaccaagttatccttaaaaactctgctctccaaatgctcagggagactgatttgagtaataaaactccagtctcccacacagctggctctgcgtgaattactttattgcaactcccctgccttgatgaattggctctgtctaggcagcaggcaaggtgaaccccttgggtggttaca

SEQ ID NO: 1189 - DNA, 914 bp, Artificial Sequence
  Synthetic polypeptide
ggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1190 - DNA, 922 bp, Artificial Sequence
  Synthetic polypeptide
atgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1191 - DNA, 790 bp, Artificial Sequence
  Synthetic polypeptide
atgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1192 - DNA, 754 bp, Artificial Sequence
  Synthetic polypeptide
atgcagagggctgtaagtgtggtggcccgtctgggctttcgcctgcaggcattccccccggccttgtgtcgtccacttagttgcgcacagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1193 - DNA, 631 bp, Artificial Sequence
  Synthetic polypeptide
atggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctcaaaaaaaaaaaaaagaaa

SEQ ID NO: 1194 - DNA, 604 bp, Artificial Sequence
  Synthetic polypeptide
atggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggacaacaacccggaggaatctccaaggaattaaacttagtgtaaaaaactcaatcccagaaaattacatg

SEQ ID NO: 1195 - DNA, 364 bp, Artificial Sequence
  Synthetic polypeptide
atgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggacaacaacccggaggaatctccaaggaattaaacttagtgtaaaaaactcaatcccagaaaattacatg

SEQ ID NO: 1196 - DNA, 639 bp, Artificial Sequence
  Synthetic polypeptide
gctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1197 - DNA, 500 bp, Artificial Sequence
  Synthetic polypeptide
ccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1198 - DNA, 1346 bp, Artificial Sequence
  Synthetic polypeptide
atggccgcgcagctgctggaggagaagctgacctgcgccatctgcctggggctctaccaggacccagtgacgctgccctgcggccacaacttctgcggggcctgcatccgggactggtgggaccgctgcggaaaggcgtgccccgagtgccgggagccctttcccgacggcgccgagctgcgccgcaacgtggccctcagcggcgtgctggaggtggtgcgcgccgggcccgcccgggatcccggccccgatcccggccccggccccgaccctgccgcgcgctgcccccgccacgggcggccgctggagctcttctgccggaccgagggccgctgtgtgtgcagcgtgtgcaccgtgcgcgagtgtcgcctccacgagcgggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggaggccccaggtcccctggcaccggtcccaagcacagtttgtccactgaggaggaaactctggcagaattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1199 - DNA, 901 bp, Artificial Sequence
  Synthetic polypeptide
gggcgctgctggatgccgagcgcctcaagcgcgaggcccagctgagagccagcctggaggttacccagcagcaggccacccaggccgaaggccagctactagagctgcgcaagcaaagcagccagatccagaactcggcctgcatcttggcctcctgggtctccggcaagttcagcagcctgctacaggccctggaaatacagcacacgacagcactgaggagcatcgaggtggccaagacgcaggcgctggcacaggctcgagacgaggagcagcggctgcgggtccatttggaggctgtggctcgccatggctgcaggatccgggagctcctggagcaggtggatgagcagaccttcctgcaggaatcgcagctcctccagcccccagggcctcttgggccactgacccctctgcagtgggatgaagaccaacagctgggtgacctgaagcagttgctaagccggctgtgtggcctcctcttggaagaggggagccaccctggggcaccagccaagcctgtggacttagcccccgtggattatcgcaatctgacctttgatccagtcagcgccaaccgtcacttctatctgtcgcgccaggaccagcaggcgcagtggctcacgcttgtaatcccagcactttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactctgtctcaaaaaaaaaaaaaaaaa

SEQ ID NO: 1200 - DNA, 1391 bp, Artificial Sequence
  Synthetic polypeptide
atggaggaggaggagggggcggtggccaaggagtggggcacgacccccgcggggcccgtctggaccgcggtgttcgactacgaggcggcgggcgacgaggagctgaccctgcggaggggcgatcgcgtccaggtgctttcccaagactgtgcggtgtccggcgacgagggctggtggaccgggcagctccccagcggccgcgtgggcgtcttccccagcaactacgtggcccccggcgcccccgctgcacccgcgggcctccagctgccccaggagatccccttccacgagctgcagctagaggagatcatcggtgtggggggctttggcaaggtctatcgggccctgtggcgtggcgaggaggtggcagtcaaggccgcccggctggaccctgagaaggacccggcagtgacagcggagcaggtgtgccaggaagcccggctctttggagccctgcagcaccccaacataattgcccttaggggcgcctgcctcaaccccccacacctctgcctagtgatggagtatgcccggggtggtgcactgagcagggtgctggcaggtcgccgggtgccacctcacgtgctggtcaactgggctgtgcaggtggcccggggcatgaactacctacacaatgatgcccctgtgcccatcatccaccgggacctcaagtccatcaacatcctgatcctggaggccatcgagaaccacaacctcgcagacacggtgctcaagatcacggacttcggcctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaaga

SEQ ID NO: 1201 - DNA, 467 bp, Artificial Sequence
  Synthetic polypeptide
caagatcacggacttcggcctcgcccgcgagtggcacaagaccaccaagatgagcgctgcggggacctacgcctggatggcgccggagaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaaga

SEQ ID NO: 1202 - DNA, 641 bp, Artificial Sequence
  Synthetic polypeptide
ctcgcccgcgagtggcacaagaccaccaagatgagcgctgcggggacctacgcctggatggcgccggaggttatccgtctctccctcttctccaaaagcagtgatgtctggagcttcggggtgctgctgtgggagctgctgacgggggaggtcccctaccgtgagatcgacgccttggccgtggcgtatggcgtggctatgaataagctgacgctgcccattccctccacgtgccccgagccctttgcccgcctcctggaggaatgctgggacccagacccccacgggcggccagatttcggtagcatcttgaagcggcttgaagtcatcgaacagtcagccctgttccagatgccactggagtccttccactcgctgcaggaagactggaagctggagattcagcacatgtttgatgaccttcggaccaaggagaagtacttacaggtgacactgcatgatgtctggggttggctttaaaatactacagcagaaacgaagagagggcaagaggagagaaggacggggatacaagattcgcaaagcataggtaattgttgaaattggatgatgggtacaggggggtgcactgttctctgcttttgtggatgtttgaagttttctaaattgaagagttaaga

SEQ ID NO: 1203 - DNA, 824 bp, Artificial Sequence
  Synthetic polypeptide
atgatcgattcaggagaaaagaagcctgggcggagagcagaggaggcagtgaccttcaaggatgtggctgtgatcttcactgaggaggagctggggctgctggaccctgcccagaggaagctgtaccgagatgtgatgcttgagaacttcaggaacctgctctcagtggggcatcaaccattccatggagatactttccacttcctaagggaagaaaagttttgggtgatggggacaacaagccaaagagaagggaatttgggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcagtttatgcaggtgtctgctgagttttaatgtcatggaagaggtcatcttcaagcaccctattgaaaataccatcctatctttacttggcctgcaagtattatgtgtcatatgcttttgtttactgatagatcacctgttccctttcaaatataatctctacaaggtgtttatctgtttgtttatgactgcatcttcagtgcctagaatagtcctagtacatggagggatctgtaaatatttggtatcctgatgaatgaat

SEQ ID NO: 1204 - DNA, 494 bp, Artificial Sequence
  Synthetic polypeptide
atgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcagtttatgcaggtgtctgctgagttttaatgtcatggaagaggtcatcttcaagcaccctattgaaaataccatcctatctttacttggcctgcaagtattatgtgtcatatgcttttgtttactgatagatcacctgttccctttcaaatataatctctacaaggtgtttatctgtttgtttatgactgcatcttcagtgcctagaatagtcctagtacatggagggatctgtaaatatttggtatcctgatgaatgaat

SEQ ID NO: 1205 - DNA, 386 bp, Artificial Sequence
  Synthetic polypeptide
atgctggagaacttcaggaacctgctgtcagtggggcatcaaccattccaccgagatactttccactttctaagggaggaaaagttttggatgatggatatagcaacccaaagggaagggaattcagtttatgcaggtgtctgctgagttttaatgtcatggaagaggtcatcttcaagcaccctattgaaaataccatcctatctttacttggcctgcaagtattatgtgtcatatgcttttgtttactgatagatcacctgttccctttcaaatataatctctacaaggtgtttatctgtttgtttatgactgcatcttcagtgcctagaatagtcctagtacatggagggatctgtaaatatttggtatcctgatgaatgaat

SEQ ID NO: 1206 - DNA, 1206 bp, Artificial Sequence; identical to SEQ ID NO: 282
  Synthetic polypeptide

SEQ ID NO: 1207 - DNA, 1209 bp, Artificial Sequence; identical to SEQ ID NO: 281
  Synthetic polypeptide

SEQ ID NO: 1208 - DNA, 1203 bp, Artificial Sequence; identical to SEQ ID NO: 286
  Synthetic polypeptide

SEQ ID NO: 1209 - DNA, 925 bp, Artificial Sequence
  Synthetic polypeptide
atgttcattaagggcagggctccgagggcgccacctcgagagcgacggcgggctacccggggcgggctgaggcaggttgtagccccgccccgggccttgggctccacctctcggccccacttccgccgggcaagcgtttgtaggcggcgctgccgtaaatcaggcggtctgcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1210 - DNA, 736 bp, Artificial Sequence
  Synthetic polypeptide
atggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1211 - DNA, 755 bp, Artificial Sequence
  Synthetic polypeptide
gcttgccgcatcacgcaagatggcggccgcggcggtgaacggggcggcaggcttctcgagctccgggcccgcggcaacctcgggcgctgttctgcaggccgcgaccggcatgtacgagcaactcaagggcgagtggaaccgtaaaagccccaatcttagcaagtgcggggaagagctgggtcgactcaagctagttcttctggagctcaacttcttgccaaccacagggaccaagctgaccaaacagcagctaattctggcccgtgacatactggagatcggggcccaatggagcatcctacgcaaggacatcccctccttcgagcgctacatggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1212 - DNA, 424 bp, Artificial Sequence
  Synthetic polypeptide
atggcccagctcaaatgctactactttgattacaaggagcagctccccgagtcagcctatatgcaccagctcttgggcctcaacctcctcttcctgctgtcccagaaccgggtggctgagttccacacggagttggagcggctgcctgccaaggacatacagaccaatgtctacatcaagcacccagtgtccctggagcaatacctgatggagggcagctacaacaaagtgttcctggccaagggtaacatccccgccgagagctacaccttcttcattgacatcctgctcgacactatcagggatgagatcgctgggtgcatcgagaaggcctacgagaaaatccttttcactgaggccacccggatcctcttcttcaacacacccaaaaagatgacagactacgccaagaagaatggggcta

SEQ ID NO: 1213 - DNA, 2033 bp, Artificial Sequence
  Synthetic polypeptide
atggaaaatcaattggctaaatcaactgaagaacgaacatttcagtaccaggattctcttccatcactgcctgttccttcacttgaagaatcattaaaaaaataccttgaatcagtcaccagaacatgctaccagataaggggtcttgatccagatgctaagagagggttcttggatctcacgcgggaaggaattcaagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacagagaacatcatgaaagtctggaaggattacaccattgaagatgccattgttgttaagaagaagtcatgaaagcagtcaagcccaaaacaataaatttctactagagaaaactatgtccagatgtacatgatttcacaggatttacgacagagccagtctaggaaatcatgaaagagattgtcgatatggcaaaaaaaagtggagggtgaaggatttcaaggtatggatgttg

SEQ ID NO: 1214 - DNA, 1949 bp, Artificial Sequence
  Synthetic polypeptide
atggaaaatcaattggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaaggttccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacagagaacatcatgaaagtctggaaggattacaccattgaagatgccattgttgttaagaagaagtcatgaaagcagtcaagcccaaaacaataaatttctactagagaaaactatgtccagatgtacatgatttcacaggatttacgacagagccagtctaggaaatcatgaaagagattgtcgatatggcaaaaaaaagtggagggtgaaggatttcaaggtatggatgttg

SEQ ID NO: 1215 - DNA, 55 bp, Artificial Sequence; identical to SEQ ID NO: 291
  Synthetic polypeptide

SEQ ID NO: 1216 - DNA, 25 bp, Artificial Sequence
  Synthetic polypeptide
atgagcgtcctttcgtttttttaaa

SEQ ID NO: 1217 - DNA, 325 bp, Artificial Sequence
  Synthetic polypeptide
atgaagaagtcttactcaggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaa

SEQ ID NO: 1218 - DNA, 537 bp, Artificial Sequence
  Synthetic polypeptide
atgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatcagcatgaaaatggactaataca

SEQ ID NO: 1219 - DNA, 375 bp, Artificial Sequence
  Synthetic polypeptide
atgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatcagcatgaaaatggactaataca

SEQ ID NO: 1220 - DNA, 363 bp, Artificial Sequence
  Synthetic polypeptide
atgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatcagcatgaaaatggactaataca

SEQ ID NO: 1221 - DNA, 1068 bp, Artificial Sequence
  Synthetic polypeptide
atgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaagaaacagtggaaccagtcctgagcatctaac

SEQ ID NO: 1222 - DNA, 1156 bp, Artificial Sequence
  Synthetic polypeptide
atgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaagcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaag

SEQ ID NO: 1223 - DNA, 919 bp, Artificial Sequence
  Synthetic polypeptide
atgatagctgtatcaacggcaaatggatacatcttgttttttcatattacatctacaagaggggacaagtacctttatgaaccagtgtatcccaagcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaag

SEQ ID NO: 1224 - DNA, 941 bp, Artificial Sequence
  Synthetic polypeptide
tgaatggaggccagatagtaccatgatagctgtatcaacggcaaatggatacatcttgttttttcatattacatctacaagaggggacaagtacctttatgaaccagtgtatcccaagcaggtttgagggatccttcctggagaaatggaaccactgaagaaaaactgctcaacaggtactagtatttgaagacctcaaaaaagtgctggctggccactaccctgctgaagtccaccagttgacagcctgcagacacgtagtcacctttttattgttaacctctaaaataagaacaaaggactaaacattgttagccattttaggaaagtttccagtgtaacttagaaacacataccagaaaaaaggaacttaaagtaaacagatacttgaaggaatgaaaacagtttgaggaaataattaacaaccttagacagattttggctaatcaaacaaggtaggatggtttaagaaaacggggggagtggatgagaaaattctcagaatgaaaagtacaatagtagaaatatattcagtaaaagcattgaaagaaacagttgaggaactttccctggatatagaataaaagacaagaataagagagaaaagagaaaattagagtttaatatgaggtttaatatctaactgactaggagttgtagaaagagagaacagggaatggagaagcttattattatattaaggaaacaaaacatgtaaatttcctagagtttaaactaaatacatcagtagattgaacaggtctaccaggtgctcagtgcaatgataaacattcacatacttgtagaaaaattaattattttgaaatttcagaacccatcggatatataaaaagaagatcctaggtacttcagaggaaaaagagctagtctgtgaataggaatgtcattgaactccacagccacacttgagaatctaaaag

SEQ ID NO: 1225 - DNA, 128 bp, Artificial Sequence; identical to SEQ ID NO: 144
  Synthetic polypeptide

SEQ ID NO: 1226 - DNA, 916 bp, Artificial Sequence
  Synthetic polypeptide
atgcagagcctttccttaggacaaacaaggcccataaaagccctggattcagccagacgaggatacaatgggacggctagctgcggagagaagctacctgctcaagagtctcccttttgctgagagctgagtagatgacgaaacaacctgtgtggagagaggagctcctcactccagggtctcctctctgctcagagctgaacactcactgggacaccctggctgtggagaggagctaccctctgtgggtctcctctgagctgttctgtcacccaataaaactcctcttcaccttgctcaccctccacttgtctgtgtacctcattcttcctagatgcaggacaagaacttgggactcactgaatggtggggctaaaagagctgtaacacaaatagggctgaaatacaccccttgcttgccatgttgtgggtaagaagaaggaaagaagaatgaagagctgcagcccttcagggagcccagacctaggagctatctgcaccatgactgtgacaccctctttagggctctgcggtttctggtgtctccaagcttctaggtgccaccgtgtttcccagtgccagccatggaagctgcttgcagtacacctggtccagctgcaggcttgcagggagccagcgcctgtgccagtgcctggagctgcatgtcccgcagtcgccagtgtgcctggctgtgcgcagtagttagaccccacgctcactcatacacccctcactgctctgtgccttgcttgcccttggcaggcatgggatccaggccagaagcatgagctgactgcagtctggcaggtcaagtgggtggaatgagcccagcaggcctgagcaaaacttgggcaaaggcgtcactggccacagatgtttctggctggtgaagtgacacccgaagaatcctgtgaca

SEQ ID NO: 1227 - DNA, 572 bp, Artificial Sequence; identical to SEQ ID NO: 159
  Synthetic polypeptide

SEQ ID NO: 1228 - DNA, 3378 bp, Artificial Sequence
  Synthetic polypeptide
atggagcggcggctgcgcgcgctggagcagctggcgcggggcgaggccggcggctgcccggggctcgacggcctcctagatctgctgctggcgctgcaccacgagctcagcagcggccccctacggcgggagcgcagcgtggcgcagttcctgagctgggccagccccttcgtatcaaaggtgaaagaactgcgtctgcagagagatgactttgagatcttgaaggtgatcggccgaggagcctttggggaggtcaccgtggtgaggcagagggacactgggcagatttttgccatgaaaatgctgcacaagtgggagatgctgaagagggctgagacagcctgtttccgggaggagcgggatgtgctcgtgaaaggggacagccgttgggtgaccactctgcactatgccttccaagacgaggagtacctgtaccttgtgatggactactatgctggtggggacctcctgacgctgctgagccgcttcgaggaccgtctcccgcccgagctggcccagttctacctggctgagatggtgctggccatccactcgctgcaccagctgggttatgtccacagggatgtcaagccagacaacgtcctgctggatgtgaacgggcacattcgcctggctgacttcggctcctgcctgcgtctcaacaccaacggcatggtggattcatcagtggcagtagggacgccggactatatctcccctgagatcctgcaggccatggaggagggcaagggccactacggcccacagtgtgactggtggtcgcttggagtctgcgcctatgagctgctctttggggagacgcccttctatgctgagtccttggtggaaacctacggcaagatcatgaaccacgaggaccacctgcagttccccccggacgtgcctgacgtgccagccagcgcccaagacctgatccgccagctgctgtgtcgccaggaagagcggctaggccgtggtgggctggatgacttccggaaccatcctttcttcgaaggcgtggactgggagcggctggcgagcagcacggccccctatattcctgagctgcgggggcccatggacacctccaactttgatgtggatgacgacaccctcaaccatccagggaccctgccaccgccctcccacggggccttctccggccatcacctgccattcgtgggcttcacctacacctcaggcagtcacagtcctgagagcagctctgaggcttgggctgccctggagcggaagctccagtgtctggagcaggagaaggtggagctgagcaggaagcaccaagaggccctgcacgcccccacagaccatcgggagctggagcagctacggaaggaagtgcagactctgcgggacaggctgccagagatgctgagggacaaggcctcattgtcccagacggatgggcccccagctggtagcccaggtcaggacagtgacctacggcaggagcttgaccgacttcaccgggagctggccgagggtcgggcagggctgcaggctcaggagcaggagctctgcagggcccaggggcagcaggaggagctgcttcagaggctacaggaggcccaggagagagaggcggccacagctagccagacccgggccctgagctcccagctggaggaagcccgggctgcccagagggagctggaggcccaggtgtcctccctgagccggcaggtgacgcagctgcagggacagtgggagcaacgccttgaggagtcgtcccaggccaagaccatccacacagcctctgagaccaacgggatgggaccccctgagggtgggcctcaggaggcccaactgaggaaggaggtggccgccctgcgagagcagctggagcaggcccacagccacaggccgagtggtaaggaggaggctctgtgccagctgcaggaggaaaaccggaggctgagccgggagcaggagcggctagaagcagagctggcccaggagcaggagagcaagcagcggctggagggtgagcggcgggagacggagagcaactgggaggcccagctcgccgacatcctcagctgggtgaatgatgagaaggtctcaagaggctacctgcaggccctggccaccaagatggcagaggagctggagtccttgaggaacgtaggcacccagacgctccctgcccggccactggaccaccagtggaaggcgcggcgactgcagaagatggaggcctcggccaggctggagctgcagtcagcgctggaggccgagatccgcgccaagcagggcctgcaggagcggctgacacaggtgcaggaggcccagctgcaggctgagcgccgtctgcaggaggccgagaagcagagccaggccctgcaacaggagctcgccatgctgcgggaggagctgcgggcccgagggccagtggacaccaagccctcaaactccctgattcccttcctgtccttccggagctcagagaaggattctgccaaggaccctggcatctcaggagaggccacaaggcatggaggagagccagatctgaggccggagggccgacgcagcctgcgcatgggggctgtgttccccagagcacccactgccaacacagcctctacagaaggtcttcctgctaagcccggctcacacacgctgcgcccccggagcttcccatccccgaccaagtgtctccgctgcacctcgctgatgctgggcctgggccgccagggcctgggttgtgatgcctgcggctacttttgtcacacaacctgtgccccacaggccccaccctgccccgtgccccctgacctcctccgcacagccctgggagtacaccccgaaacaggcacaggcactgcctatgagggctttctgtcggtgccgcggccctcaggtgtccggcggggctggcagcgcgtgtttgctgccctgagtgactcacgcctgctgctgtttgacgcccctgacctgaggctcagcccgcccagtggggccctcctgcaggtcctagatctgagggacccccagttctcggctacccctgtcctggcctctgatgttatccatgcccaatccagggacctgccacgcatctttaggttctgaaggcgccctgtgcctgtgtgcaccacattctcagtccttcacatctgtctttgcacgaaattgccggccctgcactggagcccagcccctcacctaccttgactactcctggttagttactcgtccctcaggcttcagcagaaatgtctggtctcctgggaagtcatccttcacttcccggccccggtttgggtccctctgtgttcccactaggcccgtccttgccccattatggcgctggtcgcatggctctggagttgtctgtttgcctgtctggcctactcc

SEQ ID NO: 1229 - DNA, 1034 bp, Artificial Sequence
  Synthetic polypeptide
atggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagctacttgggaggctgaagcaggagaatcgcttgaacccgggagatggaggttgcagtgagccaagatcacaccattgcactccagcatggacaacagagtgagattccgtctcaaaaaaaaaaaaaaaaagtaaaataaaaaa

SEQ ID NO: 1230 - DNA, 616 bp, Artificial Sequence
  Synthetic polypeptide
ctcgtccaccccacagaggaaacgcccaccacccacgccccgggcttgtcctcatcttcagcgcgggtggccaccctcctgccccagcgccaggccccagccggcagcatgctgaggacttcctgggagaggtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagctacttgggaggctgaagcaggagaatcgcttgaacccgggagatggaggttgcagtgagccaagatcacaccattgcactccagcatggacaacagagtgagattccgtctcaaaaaaaaaaaaaaaaagtaaaataaaaaa

SEQ ID NO: 1231 - DNA, 1916 bp, Artificial Sequence
  Synthetic polypeptide
atgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagtacctaacacagtgtctggcacatggatgggacttaagaactatcgaatgactgagtgaat

SEQ ID NO: 1232 - DNA, 1125 bp, Artificial Sequence
  Synthetic polypeptide
atgtcctctggagccccacagaagagcagcccaatggccagtggagctgaggagaccccaggcttcctggacacgctcctgcaagacttcccagccctgctgaacccagaggaccctctgccatggaaggccccagggacggtgctcagccaggaggaggtggagggcgagctggctgagctggccatgggctttctgggcagcaggaaggccccgccaccacttgctgctgctctggcccacgaagcagtttcacagctgctacagacagacctttccgaattcaggaagttgcccagggaggaagaagaagaggaggaggacgatgacgaggaggaaaaggcccctgtgaccttgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcgctattcagaaggctgaggcaggagaatcacttgaacccagaaggcggaggttgcagtgagctgagatcgcgccactccactccagcctggataacgaggaaaactctgtctcaaaaaataataataaaaataaataaaaa

SEQ ID NO: 1233 - DNA, 621 bp, Artificial Sequence
  Synthetic polypeptide
atggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcgctattcagaaggctgaggcaggagaatcacttgaacccagaaggcggaggttgcagtgagctgagatcgcgccactccactccagcctggataacgaggaaaactctgtctcaaaaaataataataaaaataaataaaaa

SEQ ID NO: 1234 - DNA, 813 bp, Artificial Sequence
  Synthetic polypeptide
atgggtctctgtccgtccacgcgggagacagcgccacctgccgtgctggatgcccaaagcctggcacagagtttctttaaccgcctttgggaagtcgccggccagtggcagaagcaggtgccattggctgcccgggcctcacagcggcagtggctggtctccatccacgccatccggaacactcgccgcaagatggaggaccggcacgtgtccctcccttccttcaaccagctcttcggcttgtctgaccctgtgaaccgcgcctactttgctgtgtttgatggtcacggaggcgtggatgctgcgaggtacgccgctgtccacgtgcacaccaacgctgcccgccagccagagctgcccacagaccctgagggagccctcagagaagccttccggcgcaccgaccagatgtttctcaggaaagccaagcgagagcggctgcagagcggcaccacaggtgtgtgtgcgctcattgcaggagcgaccctgcacgtcgcctggctcggggattcccaggtcattttggtacagcagggacaggtggtgaagctgatggagccacacagaccagaacggcaggatgagaaggcgcgcattgaagcattgggtggctttgtgtctcacatggactgctggagagtcaacgggaccctggccgtctccagagccatcgctattcagaaggctgaggcaggagaatcacttgaacccagaaggcggaggttgcagtgagctgagatcgcgccactccactccagcctggataacgaggaaaactctgtctcaaaaaataataataaaaataaataaaaa

SEQ ID NO: 1235 - DNA, 1425 bp, Artificial Sequence
  Synthetic polypeptide
atgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagggactggcctgtctgtccactgctgtaaccccgcgccggcatagggacctaaggcccactggagggcgctcatcaagtagctgctggatg

SEQ ID NO: 1236 - DNA, 1479 bp, Artificial Sequence
  Synthetic polypeptide
atgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagggactggcctgtctgtccactgctgtaaccccgcgccggcatagggacctaaggcccactggagggcgctcatcaagtagctgctggatg

SEQ ID NO: 1237 - DNA, 1164 bp, Artificial Sequence
  Synthetic polypeptide
atgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagggactggcctgtctgtccactgctgtaaccccgcgccggcatagggacctaaggcccactggagggcgctcatcaagtagctgctggatg

SEQ ID NO: 1238 - DNA, 1231 bp, Artificial Sequence
  Synthetic polypeptide
atgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggaaattgtcacagacaccccaacctttaccaaccaccaccccagtgagtcagcagccactaacatgaatgcaagaccctctaccaatagaaagattatgacttgttgaaagactcagatggttattaatacgttttagcggtaaagtatttttaaattatgtacattgttttttggacataatgctatcacacacttaataaactaagctacaatgtaaacttagttttaaacatttttttaaattattatta

SEQ ID NO: 1239 - DNA, 6375 bp, Artificial Sequence
  Synthetic polypeptide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1240 - DNA, 6039 bp, Artificial Sequence
  Synthetic polypeptide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1241 - DNA, 5592 bp, Artificial Sequence
  Synthetic polypeptide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1242 - DNA, 5856 bp, Artificial Sequence
  Synthetic polypeptide
atggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagcccccgatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagggaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctgtcttgacaactggaagaccaggagataccctcccttgcctggctcagtgggtcacacgcccatggagacttgctcactgctagcgcagcagtctgagatcaacctgcaatgctgctgcttgatgcggggaggggcgtctgccattgatgaagcttgagtagctcacagcgtaaacaaagcagcagggaagcttgaactgggcagagcccacctcagctcagcaaggcctactgcctctctagattccacctctgggggcagcacatagcagaacaaaaggcagcagacagcttccgcagacttaaacatccctgtctgacacctctgaagagggcagtggttctctcagcacagtgttcaagctccaagaaccaagagaccgccacctcaagcaggtccctgacccccatgtagcctgactgggagacacctcccagtaggggccgacagacacttcaaacaggcaggtgccctctgggacgaagcttccagaggaaggatcaggcagcaatatttgttgttctgcagcctccgctggtgatacccaggcaaacagggtctggggtggacctccagcaaactccaacaggcctgcagctgaggggcctgacggttagaaggaaaactaacaaacagaaaggaatagcatcaacatcaacaaaaaggacatccacaccaaaaccccatctgtaggtcatcaacatcaaagaccaaaggtagataaaaccacaaagatggggagaaaccagagcagaaaagtggaaaattccaaaaaccagagcgcctcttctgctccaaaggattgcagctcctcaccagcaagggaacaaaacaggatggagaatgagtttgatgagttgacagaagtaggcttcagaaggtcggtaataacaaacttctccaagctaaaggaacatgttctaacccatcgcaaggaggctaaaaaccttgaaaaaaggttagatgaatggctaactagaataaacagtgtagagaagaacttaaatgacctgatggagctgaaaaccacagcatgagaacttcgtgatgtatgcacaagcttcgatagctgatttgatcaagtggaagaaaggatatcagtgattgaagatcaaattaatgaaataaagtgagaagacaagatgagagaaaagaagagtgaaaagaaacgaacaaagcctccaagaaatatgggactatgtgaaacaaacaaatatatgtttcattggtgtactgggaagtgatggggagaatggaaccaagttagaaaacactcttcaggatattatccaggacaacttccccaacctagcaaggcaggccaacattcaaattcaggaaatacagagaacactacaaagatactcctcaagaagagcaaccccaagacacataattttcagatttaaaaagtatgaaatgaaggaaaaaatgttaagggcagccagagagaaaagtcgggttacccacaaagggaagcccatcagactaatgggatctctcagcagaaaccctacaagccagaagagagtgggggccaatattcaacattcttaaaaattcttaaaaaaagaagaattttcaacccagaatctcatatccagccaaactaagcttcataagtgaaggagaaataaaatcctttacagacaagcaaatgctgagagattttgtcaccaccaggcctgccttagaagagctcctgaaggaagcactaaacatggaaaggaacaaacagtaccagccactgcaaaaacattccaaattgtaaagaccatcgacgctatgaagaaactgcatcaattaacgggcaaaataaccagctaacatcagaatgacaggatcaaattcaaacataacaatattaaccttaaatgtaaatgggctaaatgctccaattaaaagacacagactggcaaattggataaagagtcaagactgtgctgtattcaggagacccatctcacgtgcaaaaatgcacataggctcaaaataaagggtcgaaggaaaatctactgagcaaatggaaagaaaaaaaaaagcaggggttgcaatcccagtctctgataaaacagaatttaaaccaacaaagatcaaaagagacaaagacagccacaacaagaagagctaactaccctaaatatatatgcacccagtacaggagcacccagattcataaagcaagtccttagagacctacgaagagacatagactcccacacaataataatgggagactgggagacaccccacagtcaatattaaacagatcaacaagacagaaggttaacaaggatatccaggacttgaactcagctctagaccaagtggacccaatagacatctacagaactctccacccctaatcaacagaatatacattcttctcagcaccacattgcacttattttaaaattgaccacataattggaagtaaaacactcctcagcaaatgtaaaagaacagaagtcacaacaaactgtctctcagaccacagtgcaatcaaattagaactcaggattaagaaactgactcaaatccacacagctacgtggaaactgaacaacctgctcctgaatgactactgggtaaataacaaaatgaaggcagaaataaagatgttctttgaaaccaatgagaacaaggacacaatgtaccagaatttctgggacacatttaaagcagtgtgtagagggaaatttatagcactaaatgcccacgagagaaagcaggaaagatctaaaatcgacaccctaacatcacaattgaaagaactagagaagcaagagcaaacaaattcaaaagcaagcagaaggcaagaaataactgagatcagagcagaactgaaggagacagagacacaaaaagccgttcaaaaaatcaatgaatccaggagctggttttttgaaaagatcaacaaaattgatagaccactagcaagactaataaagaagaaaagagagaagaatcgaatagatgcaataaaaaatgataaagggatatcaccaccgatcccacagaaatacaaactaccatcagagaatactataaactcctctacgcaaataaactggaaaatctagaagaaatggataaattcctggacacatacaccctcccaagactcaaccaggaagaagttgaatctctgaagacaccaataacaggtactgaaccaaggtttggaccaaccaaaaatgtccaggaccagatggattcacagttgaattctaccagaggtacaaagaggagctggtaccattccttcagaaactattccaatcaatagaaaaagagggactcctccctaactcattttatgaggccagcatcatcctggtaccaaaacctggcagagacacaacaaaaaaagagaattttaggctaatatccctgatgaacatcgatgtgaaaatcctcaataaaatactggcaaaccaaatccagcagcacatcaaaaagcctatccaccaaaaccaagtcagcttcattcctgggatgcaagactggttcaacatacgcaaataaataaatgtaatccatcacataaacagaaccaatgacaaaaaccacatgattatctcaatagatgcagaaaaggcctttgacaaaattcaacagcctttcttgctaaaaactctaaataaattaggtattgatggaacgtacctcaaaataataagagctatttatgacaaacccacagccaatatcatactgaatgggcaaaacctggaagcattccttttgaaaaccagcacaagataagaatgccctctctcaccactcctattcaacatagtgttggaagttctggctagggcaatcaggcaagagaaagaaataaagggtattcagttaggaaaagaggaagtcaaattgtctctgtttgcagatgacacgattgtatatttagaaaaccccattgtctcagcccaaaatctccttaagctgataagcaacttcagcaaagtctcaggatacaaaatcaatgtgcaaaaatcacaggcattcctgtacaccaataatagacaaacagagagccaaatcatgagtgaactcccattcagaattactacaaagagaataaaatacctaggaatccaacttacaagggatgtgaaggacctcttcaaggagaactacaaaccactgctcaacgaaataaaagaggacacaaacaaatggaagaacattccatgctcgtggataggaataatcaatatcacgaaaatggtcatactgcccaaggtaatttatagattcagtgctatccccatcaagctaccattgactttcttcacagacttggaaaaaaactactttaaagctcacatggaaccaaaaaagagcctgcatagccaagacaatcctaagcaaaaagaacaaagctggaggcatcacgctacctgacttcaaaccatactacaaggctacagtaactaaaacagcatggtactggtaccaaaatagatatatagactaatggaacagaacagaggcctcagaaatgacaccacacatctgcaaccatctgatctttgacaaacctgacaaaaacaagaaatggggaaaggattccctatttaataaatggtgctaggaaaactggctagccatatgtagaaagctgaaactggatcccttccttacactgtatacaaaaattcgctcaagaaggattaaagacttaaatgtaagacctaacacctagaagaaaacctacacaataccattcaggacataggcatgggcaaagactttatgactaaaacaccaaaagcaatggcatcaaaagccaaaatagacaaattggatctaattaaactaaagagcttctgcacagcaaaggaaactatcatcagagtgaacaggcaacctacagagtgggagaaaatttttgcaatccacccatctgacaaagggctaatatctttgtagaatctgcaaagaacttaaacaaatttacaagaaaaaaacaaacccatcaaaaaagttggcaaagg

SEQ ID NO: 1243 - DNA, 232 bp, Artificial Sequence
  Synthetic polypeptide
atgacactggcaactgacggcactgcggatatgtttggaataagatggggtcaggccacaagccaaggaacggaggcagcctcttgaacctgaaaaaggcaagaaaatggattctcccctagtgccttcagaaggaacgtggacaagcagaactgtaagataataaatttgtgttgttttacgcctttaagtttttggtaatttgttacagcaacagtgggaaactagtgca

SEQ ID NO: 1244 - DNA, 3013 bp, Artificial Sequence
  Synthetic polypeptide
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1245 - DNA, 3370 bp, Artificial Sequence
  Synthetic polypeptide
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1246 - DNA, 617 bp, Artificial Sequence
  Synthetic polypeptide
atgcggccggggggcgcactgctcgccctgctcgccagcctgctgctgctgctgctgctgcgcctgctctggtgcccggcagacgcgcccggccgcgccaggattctggtggaggaaagcagggaggccacccacggcacccccgcagcgctgaggacgctccggagcccggcgaccgcggtaccgcgcgccactaacagcacatatctgaatgagaagtcgctccaactgacggagaaatgcaaaaatctgcaatatggcattgagtctttctctaacaaaacgaaagggcccagtcccaaggcgcaaggcggcttacgtcatcagcgtgcgtcagcaagatagcagaagcggggagagagctgttctgaagacccagagagaggcctaccgggtatcacgtagcagtagatacacagactgaaacacttcctgtttacgggagactgtaaaacccctgcccgtcctcatttggggctgatgccattttaggcctcggcctgaaatggcctgaaggtctgccttcaggcattcattaaaactgcctgttgctccacactgccttgtgttgtttgttggcgttctctcagggttcgaaccaatacaagagccttgca

SEQ ID NO: 1247 - DNA, 1731 bp, Artificial Sequence; identical to SEQ ID NO: 989
  Synthetic polypeptide

SEQ ID NO: 1248 - DNA, 2262 bp, Artificial Sequence; identical to SEQ ID NO: 990
  Synthetic polypeptide

SEQ ID NO: 1249 - DNA, 2253 bp, Artificial Sequence; identical to SEQ ID NO: 991
  Synthetic polypeptide

SEQ ID NO: 1250 - DNA, 3005 bp, Artificial Sequence
  Synthetic polypeptide
atggagccctcctggcttcaggaactcatggctcaccccttcttgctgctgatcctcctctgcatgtctctgctgctgtttcaggtaatcaggttgtaccagaggaggagatggatgatcagagccctgcacctgtttcctgcaccccctgcccactggttctatggccacaaggagttttacccagtaaaggagtttgaggtgtatcataagctgatggaaaaatacccatgtgctgttcccttgtgggttggaccctttacgatgttcttcagtgtccatgacccagactatgccaagattctcctgaaaagacaagatcccaaaagtgctgttagccacaaaatccttgaatcctgggttggtcgaggacttgtgaccctggatggttctaaatggaaaaagcaccgccagattgtgaaacctggcttcaacatcagcattctgaaaatattcatcaccatgatgtctgagagtgttcggatgatgctgaacaaatgggaggaacacattgcccaaaactcacgtctggagctctttcaacatgtctccctgatgaccctggacagcatcatgaagtgtgccttcagccaccagggcagcatccagttggacagtaccctggactcatacctgaaagcagtgttcaaccttagcaaaatctccaaccagcgcatgaacaattttctacatcacaacgacctggttttcaaattcagctctcaaggccaaatcttttctaaatttaaccaagaacttcatcagttcacagagaaagtaatccaggaccggaaggagtctcttaaggataagctaaaacaagatactactcagaaaaggcgctgggattttctggacatacttttgagtgccaaaagcgaaaacaccaaagatttctctgaagcagatctccaggctgaagtgaaaacgttcatgtttgcaggacatgacaccacatccagtgctatctcctggatcctttactgcttggcaaagtaccctgagcatcagcagagatgccgagatgaaatcagggaactcctaggggatgggtcttctattacctgggaacacctgagccagatgccttacaccacgatgtgcatcaaggaatgcctccgcctctacgcaccggtagtaaacatatcccggttactcgacaaacccatcacctttccagatggacgctccttacctgcaggcaaacagagagccaaatcatgagcgaactcccattcacaattgcttcaaggagaataaaatatctaggaatccaacttacaagggatgtgaaggacctcttcaaggagaactacaaaccgctgctcaatgaaataaaagaggatacaaacaaatggaagaacattccatgctcctgggtaggaagaatcaatatcgtgaaaatggccatactgcccaaggtaatttatagtttcaatgccatccctatcaagctaccaatgactttcttcacagaattggaaaaaactactttaaagttcatatggcaccaaaaaagagtccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaacctgacaaaaacaagaaatggggaaacgattccctttttaataaatggtgctaggaaagctggctagccatatgcagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatcttattaaactaaagagcttctgcacagcaaaagaaattaccatcagagtgaacaggcaacctacagaatgggagaaaatttttgcaatctcctcatctgacaaagggctaacatccagaatctacaatgaactcaaacaaatttacaagaaaaaaacaaacaaccccatcaacaagaaggtgaaggatatgaacagacacttctcaaaagaagacatttatgcagccaacagacacatgaaaaaatgctcatcatcactggccatcagagaaatgcaaatcaaaaccacaatgagataccatctcacaccagttagaaaggcgatcattaaaaagtcaggaaacaacaggtgctggagaggatgtggagaaatagggacacttttacactgttggtgggactgtaaactagttcaaccattgtggaagtcagtgtggcgatttctcagggatctagaactagaaataccatttgacccagccatcccattactaggtatatacccaaaggattataaatcgtgccgctataaagacacatgcacacgtatgtttattgtggcactattcacaatagcaaagacttggaaccaacccaaatgtccaacaatgatagactggattaagaaaatgtggctcatatacactatggaatactatgcagccataaaaaatgatgagttcatgtcctttgtagggacacggatgaagctggaaaccatcattctcagcaaactatcgcaaggacaaaaaaccaaacgccgcatgttctcactcataggtgggaattgagcagtgagaacacattgacacaggaaggggaacatcacacaccagagcctgttgtggggtggagggaggggggatggatagcattaggagatatacctaatgttaaatgacgagttaatgggtgcagcacaccaacatggcacatgtatacatatgtaacaaaccttcatgttgtgcatatgtaccctaaaacttaaagtataattttaaaaaaaaa

SEQ ID NO: 1251 - DNA, 1382 bp, Artificial Sequence
  Synthetic polypeptide
atggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggaaacaaaccatcaggcctcccagaaagtatccgggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaaca

SEQ ID NO: 1252 - DNA, 3047 bp, Artificial Sequence
  Synthetic polypeptide
atggcttcatcattcctgcccgcgggggccatcaccggcgacagcggtggagagctgagctcaggggacgactccggggaggtggagttcccccatagccctgagatcgaggagaccagttgcctggccgagctgtttgagaaggctgccgcgcacctgcaaggcctgattcaggtggccagcagggagcagctcttgtacctgtatgccaggtacaaacaggtcaaagttggaaattgtaatactcctaaaccaagcttctttgattttgaaggaaagcaaaaatgggaagcttggaaagcacttggtgattcaagccccagccaagcaatgcaggaatatatcgcagtagttaaaaaactagatccaggttggaatcctcagataccagagaagaaaggaaaagaagcaaatacaggttttggtgggccagttattagttctctatatcatgaagaaaccatcagggaagaagacaaaaatatatttgattactgcagggaaaacaacattgaccatataaccaaagccatcaaatcgaaaaatgtggatgtgaatgtgaaagatgaagagggtagggctctacttcactgggcctgtgatcgaggacataaggaactagtcacagtgttgctgcaacatagagctgacattaactgtcaggtaccagctcagccacaatgggctagaacgccaagcgggctgttggggtgcctgattccatgcctaggctcttggacagctttggaccagacaagccttggatagccttctggacttgtcgtgggccagaggggagcccactgccctgaagggtgagttctggggttggcagcattcaccacagctgactgaagagcacttgggctttcagtgaatatcggcagtggcctggcagagctctccatgggctggtggtggtggtggcaactgggagtgggagaggctcctctgcctgtggaaaagggagggaaggactgacttgtcttatggttttagggccagcttagcctcagtaaaatagaacaccaggtagatttctaaggttttttcctccaatccctagctcccagacagcatctctggacccacccagggcctggggtaacttgcttccctgaaggaaaggacaaaaacctggctggcttccccacctgctaattgtagagccctagggccttgagtaaagataggtggtagccaggtagtgattgcagtgggccttgggcgagacccagtgctgtactggctccagatacaacccagtgcagtcccagtggtggtggccacagggtttttgcatcactccaccccaggatccaagtggctcagcacaggagagactccatttgtttgggagaaaataagggaagagaacaagagtctctgtctgataatccagataattcttctggatcttatccaagactaccatgtcactacctctatgagttttcaagaaccacagtgttattcggcttgggacccaattctcttccaatacctggaaaaccttaccaagaaaaatgggcacaaacgtgcccaaattgcgaagactacaataaattctaactcttcaatgtttaaacgccaatgactatccacaatcatcgagatcatccagggaaacacaacctcaccaaactaaataagacaccagggaccagtcctggagaaagagatatgcaacctttcagagaattcaaaataactgttttgaggaaactcaaagaaatttaagataacacagaaagcaaattcagaattctatcatataaatataaaaaagagattgaaataattaaaaagaaccaagcagaaattctagagttgaaaaatggaattgacatagtgaagaatgcatcagtctcttaatagcagaattaagcagaagaatttgtgagcttgaagacagactacttaaaaatacacagaggaaacaaaagaataaaacacacttaaaagatctagaaaacagcctcaaaagggcaaatctaagagttattggccttaaggaggagatcgagaaagagacagggatagaaagtttattcagagggatagtgtcagagaacttcccaaatctagaaaaagataccaacattcaagcacaagaaggttatagaacagttttaacctaaagaagactacctcaaggcatttaataatcaagctcccagaggtcaagggtaaagaaagcatcctaaaagcatcaagaaaaaaagaaacaacatataatggagctccaacacatctggcagcagacttttcagtggaaacctaaacaggctaggagagagtggcatgacatatttaaagtgctaaaggaaaaacaaacaaaaaaaaatttaccctagaacagtgtatcttgtgaaaatatccttcaagcatgaagaagaaataaagactgtcagacaaacaaaagctgagggattttgtcagcactacacctgtcctataagaaatgctaaagggaattcttcagtcagaaggaaaagtatgttaatgagcaataagaaattatatgaaggtacaaaactcactggtaatagtaaacacacaaatcagaatattataacactgtaattatggtttgtaaactactcttaagtagaaagactagttgatgaaccaatcaaaaataataactaggataacttttcaaaacatgggacaataagacataagcaacaaaaagttaaaaagtcagagaattaagtgaaaatgtttttattagtttttttttgcctatttgtttatgcaatcagtgttaagttgtcatcagcttaataataatgggttataagatacttgcaagcctcatgataacctcaaatcaaaaaacatatatacaaaaataaaaagcaatacattaaaatataccaacagagaaaactaccttcactaaaggaagacaggaagcaaggaaagaagaaagagaagaccagaaaacaaataacagaatggcagaagcaagtccttacctaatcaataatgacattgaatgtaaatggactaaaaactctcctatcaaaagacatagagta

SEQ ID NO: 1253 - DNA, 1743 bp, Artificial Sequence
  Synthetic polypeptide
atgagcggacacagccccacgcgcggggccatgcaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtcactcactccagaggaagccagctgctgtgtcatgaggcactcaagcagccatatggagaggctgatgtggtagggaactgagacctcctgccaacagccagcatcgtcttgccaggagggtgagtcatcttgaaagtggatcctctagccccacgcaagccttcagaagactacagccaaccctgagtaacatcttcactgcaacttcaagagagaccctgaaccaaaaatacccagctaagcctctctcagattcccagtccacagaaactgtgaaatagatgtttatagtttaagcgactaagctttggggtaatttgtcatgtagcaata

SEQ ID NO: 1254 - DNA, 1518 bp, Artificial Sequence
  Synthetic polypeptide
atgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtcactcactccagaggaagccagctgctgtgtcatgaggcactcaagcagccatatggagaggctgatgtggtagggaactgagacctcctgccaacagccagcatcgtcttgccaggagggtgagtcatcttgaaagtggatcctctagccccacgcaagccttcagaagactacagccaaccctgagtaacatcttcactgcaacttcaagagagaccctgaaccaaaaatacccagctaagcctctctcagattcccagtccacagaaactgtgaaatagatgtttatagtttaagcgactaagctttggggtaatttgtcatgtagcaata

SEQ ID NO: 1255 - DNA, 1767 bp, Artificial Sequence
  Synthetic polypeptide
atggctcggagcctctccatcatgttcgtccccaacagctggctcaatggctaccacaaggtggccatgaacggtaaggcccgcaaagaggcggtgcagactgcggctaaggaactcctcaagttcgtgaaccggagtccctctcctttccatgctgtggctgaatgccgcaaccgccttctccaggctggcttcagtgaactcaaggagactgagaaatggaatattaagcccgagagcaagtacttcatgaccaggaactcctccaccatcatagcttttgctgtagggggccagtacgttcctggcaatggcttcagcctcatcggggcccacacggacagcccctgcctccgggtgaaacgtcggtctcgccgcagccaggtgggcttccagcaagtcggtgtggagacctatggtggtgggatctggagcacctggtttgaccgtgacctgactctggctggacgcgtcattgtcaagtgccctacctcaggtcggctggagcagcagctggtgcacgtggagcggcccattcttcgcatcccacacctggccatccatctgcagcgaaatatcaacgagaactttgggcccaacacagagatgcatctagtccccattcttgccacagccatccaggaggagctggagaaggggactcctgagccagggcctctcaatgctgtggatgagcggcaccattcggtcctcatgtccctgctctgtgcccatctggggctgagccccaaggacatagtggagatggagctctgccttgcagacacccagcctgtggtcttgggtggtgcctatgatgagttcatctttgctcctcggctggacaatctgcacagctgcttctgtgccctgcaggccttgatagattcctgtgcaggccctggctccctggccacagagcctcacgtgcgcatggtcacactctatgacaacgaagaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctggacaagcatgaggagaaccaccggcctttattccacaagggccccgtgatcaaggtgaacagcaagcaacgctatgcttcaaacgcggtgtcagaggccctgatccgagaggtggccaacaaagtcaaggtccccctgcaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtcactcactccagaggaagccagctgctgtgtcatgaggcactcaagcagccatatggagaggctgatgtggtagggaactgagacctcctgccaacagccagcatcgtcttgccaggagggtgagtcatcttgaaagtggatcctctagccccacgcaagccttcagaagactacagccaaccctgagtaacatcttcactgcaacttcaagagagaccctgaaccaaaaatacccagctaagcctctctcagattcccagtccacagaaactgtgaaatagatgtttatagtttaagcgactaagctttggggtaatttgtcatgtagcaata

SEQ ID NO: 1256 - DNA, 1178 bp, Artificial Sequence
  Synthetic polypeptide
atggacgcgcaggactgccaggcggccgcatcgcccgagccgcccgggcccccagcccgtagctgcgtggccgcctggtgggacatggtcgaccgcaacctgcgatattttccacactcctgttcaatgctcggaagaaaaattgctgctctgtatgacagctttactagtaaatccttaaaagaacacgttttccttcctctgatagacatgctaatttattttaattttttcaaagccccatttcttgtggatttaaagaaaccagagttaaagattcctcacacagtgaacttctacctgagagttgaacctggggtgatgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatga

SEQ ID NO: 1257 - DNA, 947 bp, Artificial Sequence
  Synthetic polypeptide
atggacgcgcaggactgccaggcggccgcatcgcccgagccgcccgggcccccagcccgtagctgcgtggccgcctggtgggacatggtcgaccgcaacctgcggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatga

SEQ ID NO: 1258 - DNA, 857 bp, Artificial Sequence
  Synthetic polypeptide
atgctagggatctggcacacagtccccagctgccggggggaagatgccaaggggaaggactgttgctggtatgaagcagcccttcgtgatgggaacccaattattgtttatcttcatggcagtgcagaacacagggcagcttcgcacagactgaagctggtaaaggtgctgagtgatggtggctttcatgtcttgtctgttgactacagaggatttggggactctacaggtaagcccacagaggagggactgactacggatgccatttgtgtctatgagtggaccaaggcaagaagtggcatcactcccgtgtgtctctggggccactctctgggtacaggagttgcaacaaatgctgcaaaagtgctagaagaaaaaggatgcccagttgatgctattgtcttggaagctccatttaccaacatgtgggttgcaagtatcaattatcccttgttaaaggtatctgcccagatggcctgaagtaactgaagaatcacaaaagaagtgaatatgccctgccccaccttaactgatgacattccaccacaaaagaagtataaatggccggtccttgccttaagtgatgacactaccttgtgaaagtccttttcctggctcatcctggctcagaagctcccccactgagcaccttgtgacccccacccctgcccaccagagaacaaccccctttgactgtaattttccattaccttcccaaatcctataaaacagccccacccctatctcccttggctgactctcttttcggactcagcccacctgcacccaggtgaaataaacagccatgttgctcacacaaagcctgtttggtggtctcttcacacggacgcgcatga

SEQ ID NO: 1259 - DNA, 582 bp, Artificial Sequence
  Synthetic polypeptide
atgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggaggctgaggcaggaagatcacttgagcccaggagtttgaggctgcggtaagctatgattgtgtcactgcaccccaaactgggtgacatatgaagacattatctctaaaaaaattttttaaataaaaaacaaaaaa

SEQ ID NO: 1260 - DNA, 1215 bp, Artificial Sequence
  Synthetic polypeptide
atgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggaggctgaggcaggaagatcacttgagcccaggagtttgaggctgcggtaagctatgattgtgtcactgcaccccaaactgggtgacatatgaagacattatctctaaaaaaattttttaaataaaaaacaaaaaa

SEQ ID NO: 1261 - DNA, 705 bp, Artificial Sequence
  Synthetic polypeptide
atgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggaggctgaggcaggaagatcacttgagcccaggagtttgaggctgcggtaagctatgattgtgtcactgcaccccaaactgggtgacatatgaagacattatctctaaaaaaattttttaaataaaaaacaaaaaa

SEQ ID NO: 1262 - DNA, 436 bp, Artificial Sequence
  Synthetic polypeptide
atgacactggcaactgacggcactgcggatatgtttggaataaggttcaaaagaagaggctgttctaagaaagactaccgagtaatcaatcacctcctcagagaaagtctgctcaggccaggcatggtggctcacgcctgtaatcccagcgctttgggaggctgaggtggacggatcacctgaggtcaggagttcgagaccaacccggccaacatagtgaaaccctgtctctactaaaaatacaaaaaaattagctgggcatggtggcatgtgcctgtaatcccagctacccaggaggctgaggcaggagaatcgcttgaacccaggaggcagaggttgcagtgagccgagatggtgccaatgcactccagcctgggcaacagagcaggactccgtttcacacacacacacaaaaaaaaaaaaaaaaaaaaaaaaa

SEQ ID NO: 1263 - DNA, 1834 bp, Artificial Sequence; identical to SEQ ID NO: 133
  Synthetic polypeptide

SEQ ID NO: 1264 - DNA, 1765 bp, Artificial Sequence; identical to SEQ ID NO: 135
  Synthetic polypeptide

SEQ ID NO: 1265 - DNA, 980 bp, Artificial Sequence; identical to SEQ ID NO: 139
  Synthetic polypeptide

SEQ ID NO: 1266 - DNA, 1256 bp, Artificial Sequence; identical to SEQ ID NO: 140
  Synthetic polypeptide

SEQ ID NO: 1267 - DNA, 1277 bp, Artificial Sequence; identical to SEQ ID NO: 142
  Synthetic polypeptide

SEQ ID NO: 1268 - DNA, 3371 bp, Artificial Sequence
  Synthetic polypeptide
atgccaggacaccccgaaagccggaaaacgagacgcattctcactatgttgcccaggctggtcttgaactccttccctcaagtgattcttctgcctaatcctcccaaagttcttagattacagggactactggcattcagtgatgtggtcatagaattctctccagaggagtgggcatgcctggaccctgcccagcgaaatttgtatagggatgtgatgttcgagaactacagaaacctggtctccctggctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagttaaaaggactactgactcaaactctgcctcttgagttcatggttcaccacttccagcctggtgacttggtgctgattaaaacttggaaagaagacaagctccacccaagttgggaagctccctatcaagtgctcctgaccactaagatggctggatgtgcaaacagctgaacaaaggtggactcactacactcaagtcaagggactggtaaaagggaccccagaaggcaaggaaaaagaccagtggaaagtgcatgggtcacctgaggaacccttaaagttaactcttggaaaaatctaaaaggaaaacatgggctggccccatttctggaagttaatatggctgggatgggctactatacaaagagcagaaggtcaaaatggaaactggcaggggactcttccctacccaatcaggttggcaattaatgtgaccaagacgatggcacctcagaatataagatttgatacctgccaggttttaacttgtgggaatttagaaaatcagagacagttctcacaggcagataaatatcttttccctgaaccaaatacagtttacagtagggcatcaccctgccccagctgggataatgtatggtggactacccaatttcagggttgaacagtaaacatagaataggtaactctgagctggagacccttaaagaataaactacatctgtccaagggctccctgccaaataactgccagaatttaaaatgcaattctatactcatcaccattgacaatccagccattgtagaccaagaaccaaaagtagaatctgggatatatgcattaggggcagaaatcacagggaaagaccccctagggtgatttgttctcaaactaatcaagaactcaacctcccatttgcctgggactacaaccccagaccctaataaacactttagtccaccaaataatgaccctaaaagggaaaaatatggtaaaggatctaaggcaaaccttagaaattgagacagggtatggggatataaacgcctgggtcgaattggtcaaatttttggtacaagccctcaacaagagtaactgctgtgggatgaccttgggcacaggtggttccatttcccctaggatggaatacccctcctaagggactacactgtatgttggttctataccaggacaaggatgcatgcggaagtaagacttgtaagagtctgtgatcgctctttcccacattccagagctcagatcccagagcaatatccttgttctctatagggaatatgaaccacttctcttgcctctctaggcaggaggaagagttcaataatcctgtgggagaactctcaacttctgcctacatcctaaacatcactggtgagtcaagcaatggcaattactcagctctccatacaccccgggctgatgtctggtggtattgtgggaaatggaacctctgtaacctgttaccatccaatgggactaggacttgtgctttagtccaattggccattcccttcaccctggcattccataagatacccaaaaatacacatggccactgacaccagagagatttgacaaattcttttaatcccaatacatatgttaactcaattggagtccctagaggtgtgcctaatgaatttaggcctaaaaccaaatagctgctgggttttaggactcttctgatggtcaactattaataagaatgtgaa

SEQ ID NO: 1269 - DNA, 3206 bp, Artificial Sequence
  Synthetic polypeptide
atgggcacaatatcactttgcattggtgtctgtgcatttgaaggagcaaacacctctaccagtttttataaactggtttatacagctattttatcttattccattcaagaccttttgccagagcaggatatgaaagatttatgccaaaaagtgacactgacaagacatagaagctggggccttgacaatttgcacttagtgaaagactggagaactgtgaatgaaggtaaggggcagaaagaatattgcaatagacttactcaatgttcatcaactaaaagcaaaatctttcaatgtattgaatgtggcagaaattttagctggaggtcaatccttactgaacataagagaattcatactggagagaagccatacaaatgtgaagaatgtggcaaagttttcaatcgatgttcaaacctaacaaaacataaaagaattcatactggagagaaaccctacaaatgtgacgaatgtggcaaagtttttaattggtggtcacaactaactaaccataagaaaattcatactggagagaaaccctacaaatgtgatgaatgtgacaaagtttttaattggtggtcacaactaactagccataagaaaattcatagtggagagaaaccatacccatgtgaagaatgtggcaaagcctttacccagttctcaaaccttacacaacataagagaattcatactggagagaaaccctacaaatgcaaagaatgttgcaaagcctttaacaagttctcaaaccttactcaacataagagaattcatactggagagaaaccttacaagtgtgaagaatgtggcaacgtttttaatgagtgctcacacctaactagacataggagaattcatactggagagaaaccctacaaatgtgaagaatgtggcaaagcctttacacagtttgcaagccttactcgtcataaaagaattcatactggagaaaaaccctaccaatgtgaagaatgtggcaaaacttttaatcggtgttcacacctaagtagccataagagaattcatactggagagaaaccctacaaatgtgaagaatgtggcagaacctttactcaattctcaaacctcactcagcataaaagaattcatactggagagaaaccctacaaatgcaaagaatgtggcaaagcgtttaacaagttctcaagccttactcaacataggagaattcatactggagtgaaaccctacaaatgtgaagaatgtgggaaagtttttaaacagtgctctcacctaactagccataagagaattcatactggagagaaaccctacaaatgtaaagaatgtggcaaagctttttaccaatcctcaatccttagtaagcataagagaattcatactgaagagaaaccctacaaatgtgaagaatgtggcaaagcctttaaccagttctcaagccttactcgtcataaaagaattcatactggagagaaacgctacaaatgtaaagaatgtggaaaaggtttttaccaatcctcaatccatagttaaaaggactactgactcaaactctgcctcttgagttcatggttcaccacttccagcctggtgacttggtgctgattaaaacttggaaagaagacaagctccacccaagttgggaagctccctatcaagtgctcctgaccactaagatggctggatgtgcaaacagctgaacaaaggtggactcactacactcaagtcaagggactggtaaaagggaccccagaaggcaaggaaaaagaccagtggaaagtgcatgggtcacctgaggaacccttaaagttaactcttggaaaaatctaaaaggaaaacatgggctggccccatttctggaagttaatatggctgggatgggctactatacaaagagcagaaggtcaaaatggaaactggcaggggactcttccctacccaatcaggttggcaattaatgtgaccaagacgatggcacctcagaatataagatttgatacctgccaggttttaacttgtgggaatttagaaaatcagagacagttctcacaggcagataaatatcttttccctgaaccaaatacagtttacagtagggcatcaccctgccccagctgggataatgtatggtggactacccaatttcagggttgaacagtaaacatagaataggtaactctgagctggagacccttaaagaataaactacatctgtccaagggctccctgccaaataactgccagaatttaaaatgcaattctatactcatcaccattgacaatccagccattgtagaccaagaaccaaaagtagaatctgggatatatgcattaggggcagaaatcacagggaaagaccccctagggtgatttgttctcaaactaatcaagaactcaacctcccatttgcctgggactacaaccccagaccctaataaacactttagtccaccaaataatgaccctaaaagggaaaaatatggtaaaggatctaaggcaaaccttagaaattgagacagggtatggggatataaacgcctgggtcgaattggtcaaatttttggtacaagccctcaacaagagtaactgctgtgggatgaccttgggcacaggtggttccatttcccctaggatggaatacccctcctaagggactacactgtatgttggttctataccaggacaaggatgcatgcggaagtaagacttgtaagagtctgtgatcgctctttcccacattccagagctcagatcccagagcaatatccttgttctctatagggaatatgaaccacttctcttgcctctctaggcaggaggaagagttcaataatcctgtgggagaactctcaacttctgcctacatcctaaacatcactggtgagtcaagcaatggcaattactcagctctccatacaccccgggctgatgtctggtggtattgtgggaaatggaacctctgtaacctgttaccatccaatgggactaggacttgtgctttagtccaattggccattcccttcaccctggcattccataagatacccaaaaatacacatggccactgacaccagagagatttgacaaattcttttaatcccaatacatatgttaactcaattggagtccctagaggtgtgcctaatgaatttaggcctaaaaccaaatagctgctgggttttaggactcttctgatggtcaactattaataagaatgtgaa

SEQ ID NO: 1270 - DNA, 366 bp, Artificial Sequence
  Synthetic polypeptide
atggcggcggccgcgctaaggttccccgttcagggcacagtgacttttgaagacgtggctgtgaaatttacccaggaggaatggaatctccttagtgaggctcagagatgcctgtaccgtgatgtgacgctggagaacctggcacttatgtcctccctgggttgttggtgtggagtggaagatgaggcggcaccttctaagcagagtatttatatacaaagagagactcagggaaagaaacagtagctccactcctgccggtccctcccctaggggagagggaagcagaggagaaaacagcagcataggtggctggcaaagacaaaggaaagaccagtagaagagaaagaaaccaaaaacagcaag

SEQ ID NO: 1271 - DNA, 1049 bp, Artificial Sequence; identical to SEQ ID NO: 224
  Synthetic polypeptide

SEQ ID NO: 1272 - DNA, 1502 bp, Artificial Sequence
  Synthetic polypeptide
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagagttaattttgagtggtcctgacctaatcaactgagacattttaaaagagtctggaagtcagagaccctctttcctgctagcctggaagaagcaagcctcaaaaagtctgcagctgcaaggaaatgaattttgccaataattatgtgcgcttggaagaagactcagcctaagatgagatctaagccctggctgacacctccattgcagctttgtgggaccttgagcggagaacccagttaagttctgcctggactcctgacccactaaaactgtgagaaaatgaatgtgtgttgttttaagccactaaatttatagttatttgttatgtagcagtagaaaacaaacaca

SEQ ID NO: 1273 - DNA, 2713 bp, Artificial Sequence
  Synthetic polypeptide
atggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccattgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcagctagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggcactctgtgggctaacagtggcc

SEQ ID NO: 1274 - DNA, 228 bp, Artificial Sequence
  Synthetic polypeptide
ataccatctgttcatttttgaaggaaaactgcttccggaattctcccatcaaagtgatcaaggtggtcaaggagcggcagttcgaggtcaagtttgaagtctccaaatgggagaatccccgcgtgctgagcttctcactgacatcccagacgatgctggaccagagtgtggactttgatgtgctgccagcctttgacgccctaggcactctgtgggctaacagtggcc

SEQ ID NO: 1275 - DNA, 592 bp, Artificial Sequence
  Synthetic polypeptide
atgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtattttcacatgcaattgtaaagcttgcctatgctgcagccaccctgtgacctaggtgggaaatatagcggcactttgaagatgacaggacagaaagatgaaaagcagtgtcttcaatgacatcaatgagcttctgaccccaccctgcaactgcctacctatggctagtcttgttctgtgagacaataacaataataaaatccaattgtttgaggcacttttattggggtattcagtttcttgcacctgaaagcaccctaactgata

SEQ ID NO: 1276 - DNA, 1692 bp, Artificial Sequence; identical to SEQ ID NO: 1048
  Synthetic polypeptide

SEQ ID NO: 1277 - DNA, 1695 bp, Artificial Sequence; identical to SEQ ID NO: 1049
  Synthetic polypeptide

SEQ ID NO: 1278 - DNA, 466 bp, Artificial Sequence; identical to SEQ ID NO: 1050
  Synthetic polypeptide

SEQ ID NO: 1279 - DNA, 669 bp, Artificial Sequence
  Synthetic polypeptide
atgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggggacatggatggagcaggaggccattatcctcagcaaactaacacaggaatggaaaaccaaataccgcatattctctcttataagtgggagctgcatgatgagaacacatggacacaatgggaggaacaacacacactggggcctgttggagggcgggaggtgggaggaaggagagcatcaggaagaatagttcatggatgctgggcttaatacctaagtgatgggatgatctttacagcaaaccaccatggcatacatttcctatgtaacaaacctgcacatcttgcacatgtatccctgaacttaaaagctggaaaaaaataaa

SEQ ID NO: 1280 - DNA, 528 bp, Artificial Sequence
  Synthetic polypeptide
atgcagcggaccgggggcggggctccgaggcccgggcgcaaccacgggctcccaggcagcctccgccagccggaccccgtcgccctcctgatgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaaccctgagagctgctcaagggtggggcctgtgtcttgtctt

SEQ ID NO: 1281 - DNA, 438 bp, Artificial Sequence
  Synthetic polypeptide
atgctgctcgtggacgctgatcagccggagcccatgcgcagcggggcgcgcgagctcgcgctcttcctgacccccgagcctggggccgaggcgaaggaggtggaggagaccatcgagggcatgctcctcaggctggaagagttttgcagcctggctgacctgatcaggagtgatacttcacagatcctggaggaaaacatcccagtccttaaggccaaactgacagaaatgcgtggcatctatgccaaagtggaccggctagaggccttcgtcaagatggttggacaccacgtcgccttcctggaagcagacgtgcttcaggctgagcgggaccatggggccttccctcaggccctgcggaggtggctgggatccgcagggctcccctccttcaggaaccctgagagctgctcaagggtggggcctgtgtcttgtctt

SEQ ID NO: 1282 - DNA, 728 bp, Artificial Sequence; identical to SEQ ID NO: 269
  Synthetic polypeptide

SEQ ID NO: 1283 - DNA, 663 bp, Artificial Sequence; identical to SEQ ID NO: 271
  Synthetic polypeptide

SEQ ID NO: 1284 - DNA, 1726 bp, Artificial Sequence
  Synthetic polypeptide
atgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggacatcattggaggaagtcactgcatatatggtgggaatagcaagagaactattggaattggaaatggatcctggagatgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctg

SEQ ID NO: 1285 - DNA, 807 bp, Artificial Sequence
  Synthetic polypeptide
ggcatttgcacgccaaaggcaaagaagaaaaaatgtccaaatcattaaagaactacattactattaaggacatcattggaggaagtcactgcatatatggtgggaatagcaagagaactattggaattggaaatggatcctggagatgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctg

SEQ ID NO: 1286 - DNA, 992 bp, Artificial Sequence
  Synthetic polypeptide
ctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggacatcattggaggaagtcactgcatatatggtgggaatagcaagagaactattggaattggaaatggatcctggagatgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctg

SEQ ID NO: 1287 - DNA, 7808 bp, Artificial Sequence; identical to SEQ ID NO: 1143
  Synthetic polypeptide

SEQ ID NO: 1288 - DNA, 1874 bp, Artificial Sequence; identical to SEQ ID NO: 1144
  Synthetic polypeptide

SEQ ID NO: 1289 - DNA, 609 bp, Artificial Sequence; identical to SEQ ID NO: 249
  Synthetic polypeptide

SEQ ID NO: 1290 - DNA, 738 bp, Artificial Sequence; identical to SEQ ID NO: 250
  Synthetic polypeptide

SEQ ID NO: 1291 - DNA, 537 bp, Artificial Sequence; identical to SEQ ID NO: 251
  Synthetic polypeptide

SEQ ID NO: 1292 - DNA, 684 bp, Artificial Sequence; identical to SEQ ID NO: 253
  Synthetic polypeptide

SEQ ID NO: 1293 - DNA, 285 bp, Artificial Sequence; identical to SEQ ID NO: 255
  Synthetic polypeptide

SEQ ID NO: 1294 - DNA, 552 bp, Artificial Sequence; identical to SEQ ID NO: 254
  Synthetic polypeptide

SEQ ID NO: 1295 - DNA, 964 bp, Artificial Sequence
  Synthetic polypeptide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaat

SEQ ID NO: 1296 - DNA, 445 bp, Artificial Sequence
  Synthetic polypeptide
atggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaat

SEQ ID NO: 1297 - DNA, 319 bp, Artificial Sequence
  Synthetic polypeptide
cataacgactatatgtgtccagccaccaaccagtgcaccattgataaaaacaggaggaagagctgccaggcctgccggctccgtaaatgctacgaagtgggaatgatgaaaggtgtcacttcctcccatccactgtgctttcggcagttcattcgttcattaattcattcaacgaatattgaataacttttgatcaatgtcttcctccctccaagctgaaaacttgatggagggtaacatgatctgtctttgtttaccactgcatcttccgtgaatatacattgtaagtattgaacggatttttactaaatgaacaaat

SEQ ID NO: 1298 - DNA, 494 bp, Artificial Sequence
  Synthetic polypeptide
atgccccctttcctgttgctggaagccgtctgtgttttcctgttttccagagtgcccccatctctccctctccaggaagtccatgtaagcaaagaaaccatcgggaagatttcagctgccagcaaaatgatgtggtgctcggctgcagtggacatcatgtttctgttagatgggtctaacagcgtcgggaaagggagctttgaaaggtccaagcactttgccatcacagtctgtgacggtctggacatcagccccgagagggtcagagtgggagcattccagttcagttccactcctcatctggaattccccttggattcattttcaacccaacaggaagtgaaggcaagaatcaagaggatggttttcaaatcccatttcttcaactagactgggagttctttaagggatgggatcgtggttatacttcctggtctccatttcactatcttccctctagtggatccacagtaaatactcacaggttgaaaaaa

SEQ ID NO: 1299 - DNA, 3628 bp, Artificial Sequence; identical to SEQ ID NO: 330
  Synthetic polypeptide

SEQ ID NO: 1300 - DNA, 3127 bp, Artificial Sequence; identical to SEQ ID NO: 332
  Synthetic polypeptide

SEQ ID NO: 1301 - DNA, 1158 bp, Artificial Sequence
  Synthetic polypeptide
atgttggcactcttggttctggtgactgtggccctggcatctgctcatcatggtggtgagcactttgaaggcgagaaggtgttccgtgttaacgttgaagatgaaaatcacattaacataatccgcgagttggccagcacgacccagattgacttctggaagccagattctgtcacacaaatcaaacctcacagtacagttgacttccgtgttaaagcagaagatactgtcactgtggagaatgttctaaagcagaatgaactacaatacaaggtactgataagcaacctgagaaatgtggtggaggctcagtttgatagccgggttcgtgcaacaggacacagttatgagaagtacaacaagtgggaaacgatagaggcttggactcaacaagtcgccactgagaatccagccctcatctctcgcagtgttatcggaaccacatttgagggacgcgctatttacctcctgaaggttggcaaagctggacaaaataagcctgccattttcatggactgtggtttccatgccagagagtggatttctcctgcattctgccagtggtttgtaagagaggctgttcgtacctatggacgtgagatccaagtgacagagcttctcgacaagttagacttttatgtcctgcctgtgctcaatattgatggctacatctacacctggaccaagagccgattttggagaaagactcgctccacccatactggatctagctgcattggcacagaccccaacagaaattttgatgctggttggtgtgaaattggagcctctcgaaacccctgtgatgaaacttactgtggacctgccgcagagtctgaaaaggagaccaaggccctggctgatttcatccgcaacaaactctcttccatcaaggcatatctgacaatccactcgtactcccaaatgatgatctacccttactcatatgcttacaaactcggtgagaacaatgctgagttgatgacatttggcaatgtttgggagacatctttggttgtcataactgtcgagctctactggcatctagtgagtagaggccaagggatgctgataaacatcctacaatgcacagaacagccctcccatccccaacaaattatccagcccaaaacgtcaagagtgccaaggttgagaaac

SEQ ID NO: 1302 - DNA, 150 bp, Artificial Sequence
  Synthetic polypeptide
atggtcttgctgacttcaagaatgaagccgctgacctcgcgcataattagcatcatcattattctggctggagcaattgcactcatcattggctttggtatttcagtctcaggtgtgtctttatcagcagcatgaaaatggactaatata

SEQ ID NO: 1303 - DNA, 141 bp, Artificial Sequence
  Synthetic polypeptide
atggcttccctggggcagatcctcttctggagcataattagcatcatcattattctggctggagcaattgcactcatcattggctttggtatttcagtctcaggtgtgtctttatcagcagcatgaaaatggactaatata

SEQ ID NO: 1304 - DNA, 517 bp, Artificial Sequence
  Synthetic polypeptide
atgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgttctaccctagacctactgaatctgaaactgggagagtaagactgaattttcagctctccaaatgattctcctgtaacccaaagtttgagaaccactg

SEQ ID NO: 1305 - DNA, 337 bp, Artificial Sequence
  Synthetic polypeptide
atggacaaggcaatggttgaatttgctacattggatcggcaactaaaccattatgtaaaggctgttcaatctacaataaatcatgtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgttctaccctagacctactgaatctgaaactgggagagtaagactgaattttcagctctccaaatgattctcctgtaacccaaagtttgagaaccactg

SEQ ID NO: 1306 - DNA, 775 bp, Artificial Sequence; identical to SEQ ID NO: 215
  Synthetic polypeptide

SEQ ID NO: 1307 - DNA, 1827 bp, Artificial Sequence
  Synthetic polypeptide
cctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaaatctagaagaaatggatacattcctcgacacatacactctcccaagactaaaccaggaagaagttgaatctctgaatagaccaataacaggagctgaaattgtgacaataatcaatagtttaccaaccaaaaagagtccaggaccagatggattcacagccgaattctaccagaggtacaaggaggaactggtaccattccttctgaaactattccaatcaatagaaaaggagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaataca

SEQ ID NO: 1308 - DNA, 1788 bp, Artificial Sequence
  Synthetic polypeptide
atgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaaatctagaagaaatggatacattcctcgacacatacactctcccaagactaaaccaggaagaagttgaatctctgaatagaccaataacaggagctgaaattgtgacaataatcaatagtttaccaaccaaaaagagtccaggaccagatggattcacagccgaattctaccagaggtacaaggaggaactggtaccattccttctgaaactattccaatcaatagaaaaggagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaataca

SEQ ID NO: 1309 - DNA, 586 bp, Artificial Sequence; identical to SEQ ID NO: 401
  Synthetic polypeptide

SEQ ID NO: 1310 - DNA, 829 bp, Artificial Sequence; identical to SEQ ID NO: 402
  Synthetic polypeptide

SEQ ID NO: 1311 - DNA, 1060 bp, Artificial Sequence; identical to SEQ ID NO: 403
  Synthetic polypeptide

SEQ ID NO: 1312 - DNA, 730 bp, Artificial Sequence; identical to SEQ ID NO: 406
  Synthetic polypeptide

SEQ ID NO: 1313 - DNA, 496 bp, Artificial Sequence; identical to SEQ ID NO: 408
  Synthetic polypeptide

SEQ ID NO: 1314 - DNA, 1491 bp, Artificial Sequence
  Synthetic polypeptide
aacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagatagg

SEQ ID NO: 1315 - DNA, 3693 bp, Artificial Sequence
  Synthetic polypeptide
atggagcccagactgttctgctggaccactctctttctcctggccgggtggtgcctgccagggttgccctgccccagccggtgcctttgctttaagagcaccgtccgctgcatgcacttgatgctggaccacattcctcaggtaccacagcagaccacagttctagacttgaggtttaacagaataagagaaattccagggagcgccttcaagaaactcaagaatttgaacacacttctgctgaacaacaaccacatcagaaagatttccagaaatgcttttgaaggacttgaaaatttgctatatctgtacctgtataagaatgaaatccatgcactagataagcaaacatttaaaggactcatatctttggaacatctgtatattcatttcaaccaactagaaatgctacagccagagacctttggagaccttctgagattagagcgactatttttgcataacaacaaattatctaaaattccagctgggagcttttctaatctggattcattaaaaagattgcgtctggattccaacgccctggtttgtgactgtgatctgatgtggctgggggagcttttacaaggctttgcccaacacggccacacccaggctgcggctacctgcgaatatcccaggagactccatgggcgtgcagttgcttcagtaacagtagaggaattcaattgccagagcccccgaattacttttgagccgcaggatgtggaggtaccatcaggaaataccgtctacttcacctgccgggcggaaggaaaccccaaacctgagattatttggatacacaacaaccactcattggatttggaagatgatactcgacttaatgtgtttgatgatggcacactcatgatccgaaacaccagagagtcagaccaaggtgtctatcagtgcatggccagaaattccgctggggaagccaagacacagagtgccatgctcagatactccagtcttccagccaaaccaagctttgtaatccagcctcaggacacagaggttttaattggcaccagcacaactttggaatgtatggccacaggccacccacaccctcttatcacttggaccagggacaatggattggagctggatggatccaggcacgtggcaacgtccagtggactttacttacagaacatcacacaacgggatcatggtcgatttacctgtcatgccaacaatagccacggcactgttcaagctgcagcaaacataattgtacaagctcctccacaatttacagtaacccccaaggatcaagtggtgctggaagaacatgctgtagagtggctctgtgaagctgacggcaacccacctcctgttattgtctggacaaaaacaggagggcagctccctgtggaaggccagcatacagttctctcctctggcactttgagaattgaccgtgcagcacagcacgatcaaggccaatatgaatgtcaagcagtcagttcgttgggggtgaaaaaggtgtctgtgcagctgactgtaaaacccaaagctcttgcagtgtttactcaacttcctcaggatacaagtgtcgaggttggaaagaatataaacatttcatgtcatgctcaaggagaaccacagcccataattacttggaataaggaaggtgtgcagattactgagagtggtaaattccatgtggatgatgaaggcacgctgactatctacgacgcagggttccctgaccagggaagatatgaatgtgtggctcggaattcttttggccttgctgtgaccaacatgtttcttacagtcacggctatacagggtagacaagctggcgatgactttgttgaatcttccattcttgatgctgtacagagagttgacagtgcaattaactccacacgaagacatttgttttcacaaaaacctcacacctccagtgacctgctggctcaatttcattacccgcgtgacccactgattgtggaaatggcaagagcaggggagatttttgagcacacgctgcagctgatacgggaacgtgtgaagcaggggctcactgtggacttggaaggcaaagaattccggtacaatgacttggtgtccccgcgctccctcagcctcatcgccaatttatctggatgcacagctcgcaggcctctgccaaactgctccaaccggtgtttccatgcgaagtaccgcgcccacgacggcacgtgcaacaacctgcagcagcccacgtggggcgcggcgctgaccgccttcgcgcgcctgctgcagccagcctaccgggacggcatccgcgcgccccgcgggctcggccttcctgtgggctcccgccagcccctcccgccgccccggctggtcgccacagtgtgggcgcgcgcggcggccgtcacccccgaccacagctacacgcgcatgctcatgcactggggctggtttctagagcacgacttggaccacacagtgcctgcgctgagcacagcccgcttctcggatgggcggccgtgcagctccgtctgcaccaacgaccctccttgtttccccatgaacacccggcacgccgacccccggggcacccacgcgccctgcatgctcttcgcgcgctccagccccgcgtgtgccagcggccgtccctctgcgacggtggattcagtctatgcacgagagcagatcaaccagcaaacagcctacatcgatggctccaacgtttacgggagctcggagcgggaatcccaggctctcagagacccttcggtgcctcggggtctcctgaagacaggctttccttggcctccctccggaaagcccttattgcccttttctacaggcccacccaccgagtgcgcgcgacaggagcaggagagcccctgtttcctggccggggaccaccgggccaacgagcatctggctctggccgccatgcacaccctgtggttccgggaacacaacaggatggccacggagctgtccgccctgaacccccactgggagggaaacacggtttaccaggaagccaggaagatcgtgggcgcggagctgcagcacatcacctacagccactggctgcctaaggtcctgggggaccctggcactaggatgctgaggggttaccgaggctacaaccccaacgtgaatgcaggcatcattaactcttttgctactgcagcctttagatttggccacacattaatcaatcctattctttaccgactgaatgccaccttaggtgaaatttccgaaggccaccttccgttccataaagcgctcttttcaccgtccagaataatcaaggaaggtgggatagacccggttctccgggggctgtttggcgtggctgctaaatggcgggcaccctcctaccttctcagtcctgagctgacccagaggctcttctccgcggcttattctgcggccgtggattcggctgccaccatcattcaaaggggtagagaccacgggatcccaccatatgttgacttcagagttttctgtaatttgacttcagttaagaactttgaggatcttcaaaatgaaattaaagattcagagattagacaaaaactgagaaagttgtacggctctccaggtgacattgacctctggcccgcccttatggttgaagacctgattcctggtacaagagtgggaccaacacttatgtgcctgtttgttacccagtttcagcggctaagagatggagatagg

SEQ ID NO: 1316 - DNA, 3093 bp, Artificial Sequence; identical to SEQ ID NO: 341
  Synthetic polypeptide

SEQ ID NO: 1317 - DNA, 2979 bp, Artificial Sequence; identical to SEQ ID NO: 342
  Synthetic polypeptide

SEQ ID NO: 1318 - DNA, 3078 bp, Artificial Sequence; identical to SEQ ID NO: 343
  Synthetic polypeptide

SEQ ID NO: 1319 - DNA, 3072 bp, Artificial Sequence; identical to SEQ ID NO: 346
  Synthetic polypeptide

SEQ ID NO: 1320 - DNA, 1935 bp, Artificial Sequence; identical to SEQ ID NO: 347
  Synthetic polypeptide

SEQ ID NO: 1321 - DNA, 1096 bp, Artificial Sequence; identical to SEQ ID NO: 348
  Synthetic polypeptide

SEQ ID NO: 1322 - DNA, 902 bp, Artificial Sequence; identical to SEQ ID NO: 349
  Synthetic polypeptide

SEQ ID NO: 1323 - DNA, 874 bp, Artificial Sequence; identical to SEQ ID NO: 350
  Synthetic polypeptide

SEQ ID NO: 1324 - DNA, 453 bp, Artificial Sequence
  Synthetic polypeptide
atgcgcttgctccagctcctgttcagggccagccctgccaccctgctcctggttctctgcctgcagttgggggccaacaaagctcaggacaacacgttggatgaagcaaactaccattctggaaagacccagatggcaagaaattgaaggtggcctctaaccaacagctagcaaggaactgaggccctcagtccaaaacccacagggaactgaatgctgccaacaaccatgtgggcttggaaacatgcccttccatcattaagccttcagaaagaacgtatccctggcaaacacctggattgtagcctgtgaaaaatgctgaagcagaggacccagttaatctgtgcccaaaattcttgaccccagaaactgaaagataataaatgtgtgtgcatgttttttaaggcactgcatttgtggtaattcattatgcaccaatagataactaataca

SEQ ID NO: 1325 - DNA, 970 bp, Artificial Sequence
  Synthetic polypeptide
atgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcagcctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggctgaggcaggagaatcgcttaaacccaggaggcggagttcacagtaagccaagatcgcgccattgcactctagcctgggcaacaagagtgaaactccgtctcaaaaaaaaaaaaaaaa

SEQ ID NO: 1326 - DNA, 2849 bp, Artificial Sequence
  Synthetic polypeptide
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1327 - DNA, 1925 bp, Artificial Sequence
  Synthetic polypeptide
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1328 - DNA, 2729 bp, Artificial Sequence
  Synthetic polypeptide
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1329 - DNA, 2549 bp, Artificial Sequence
  Synthetic polypeptide
atgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcaggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctagaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagggttatgggaggatgaggtg

SEQ ID NO: 1330 - DNA, 2361 bp, Artificial Sequence
  Synthetic polypeptide
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1331 - DNA, 2160 bp, Artificial Sequence
  Synthetic polypeptide
atggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1332 - DNA, 1908 bp, Artificial Sequence
  Synthetic polypeptide
atgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1333 - DNA, 2175 bp, Artificial Sequence
  Synthetic polypeptide
atgtctgttttcagggacagagcagaatgggctgatatagatccggtgccgcagaatgatggccccaatcccgtggtccagatcatttatagtgacaaatttagagatgtttatgattacttccgagctgtcctgcagcgtgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctg

SEQ ID NO: 1334 - DNA, 712 bp, Artificial Sequence; identical to SEQ ID NO: 1187
  Synthetic polypeptide

SEQ ID NO: 1335 - DNA, 721 bp, Artificial Sequence; identical to SEQ ID NO: 414
  Synthetic polypeptide

SEQ ID NO: 1336 - DNA, 1155 bp, Artificial Sequence
  Synthetic polypeptide
atgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1337 - DNA, 1176 bp, Artificial Sequence
  Synthetic polypeptide
atgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1338 - DNA, 903 bp, Artificial Sequence
  Synthetic polypeptide
atgactgtgaggcctccccagccatgtggaactggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1339 - DNA, 627 bp, Artificial Sequence
  Synthetic polypeptide
gcacagcccggcggcagcagctggaggaggatcgcactgctcatcttggccatcactatacacaacgttccagagggtctcgctgttggagttggatttggggctatagaaaagacggcatctgctacctttgagagtgccaggaaacccactcctaagaatctaccctaaagatacacctccaagaatatgaaactacgtagacacacaaggtaatccattacaacattgtaattgcaaaatattggaggcaacctaaatgcccatatgtgggagagtggatgagtaagctatagtgtagccacaccatggattagtatatagccatcaaaaagagtgggaagatctctgtgaactcatttagaggagttttcaggatatactgttaaatgaaaaaagctaaatacaaatgagtatctgtagtatactgtcactgatgtaaaaaggaaggagatataagaaaatacacatatatccacttacttgtgcagaagatacttggaaggataaaacaggaccaaagaagacagattacctagagagggtatgtggcaagggagggaaggagggagtaggggtggggaacaagggtgaggaggaagtgacagttgtctatacaagtctacc

SEQ ID NO: 1340 - DNA, 1180 bp, Artificial Sequence
  Synthetic polypeptide
atggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggcacctttcagcagcggccttgcttcctgcctccctccgccacctcctgcagatttctcctgggatcgccttccaaataaaccacctgcatttggggtctgtgtctggtggaaccc

SEQ ID NO: 1341 - DNA, 128 bp, Artificial Sequence; identical to SEQ ID NO: 144
  Synthetic polypeptide

SEQ ID NO: 1342 - DNA, 588 bp, Artificial Sequence
  Synthetic polypeptide
atgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaa

SEQ ID NO: 1343 - DNA, 402 bp, Artificial Sequence
  Synthetic polypeptide
atgactcctgctcagattcagaccttgctcaggaaaggggaaaagtttggtcgaggagtgatagcgggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaa

SEQ ID NO: 1344 - DNA, 500 bp, Artificial Sequence
  Synthetic polypeptide
atgttcccagcctccccctgggcacagccagcccaggccaagtggtctaggacactttgccagcaaggacaagatgatttgcttaataaaaaaaaaaaaaaaaaaaaaagactgcatccagccagataaggacataaacaagcacgctcctccactgtcagtcctcaccagaggactctatggtcataaacagctcaaaactgcggtcttaacagactcagtcttgctgtcactcatgatgagaacccagcattggctaccaaaggctctgccacatcaaagactcttccttgcaggaccaaaggactgcctggcccagaccaggagattctttttggcttcgttgctctccctggactggtttgttaaacctttctcctatctctattctcttgatgttgaatgttactttttgtctgtttgtggaatgtttaatctataacatttatgtattaagtatactattatctatggtttgcaatattgactgactttgtgga

SEQ ID NO: 1345 - DNA, 1018 bp, Artificial Sequence
  Synthetic polypeptide
atggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatct

SEQ ID NO: 1346 - DNA, 925 bp, Artificial Sequence
  Synthetic polypeptide
atgggtgttgggacgaaggcgagggcctcccactggcggcgccttttgagccttggggccactccggaggagcctctgttggacttcaagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatct

SEQ ID NO: 1347 - DNA, 736 bp, Artificial Sequence
  Synthetic polypeptide
atgactatgaatatgaagagataccagatgacaattttagcatcccagaaggtgaagaagatctggcaaaagcaattcagatggcccaagaacaggctacagatactgaaattttggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatct

SEQ ID NO: 1348 - DNA, 500 bp, Artificial Sequence; identical to SEQ ID NO: 204
  Synthetic polypeptide

SEQ ID NO: 1349 - DNA, 656 bp, Artificial Sequence; identical to SEQ ID NO: 205
  Synthetic polypeptide

SEQ ID NO: 1350 - DNA, 524 bp, Artificial Sequence; identical to SEQ ID NO: 207
  Synthetic polypeptide

SEQ ID NO: 1351 - DNA, 588 bp, Artificial Sequence
  Synthetic polypeptide
atgaagtttggctgcctctccttccggcagccttatgctggctttgtcttaaatggaatcaagactgtggagacgcgctggcgtcctctgctgagcagccagcggaactgtaccatcgccgtccacattgctcacagggactgggaaggcgatgcctgtcgggagctgctggtggagagactcgggatgactcctgctcagattcaggccttgctcaggaaaggggaaaagtttggtcgaggagtgatagcgggactcgttgacattggggaaactttgcaatgccccgaagacttaactcccgatgaggttgtggaactagaaaatcaagctgcactgaccaacctgaagcagaagtacctgactgtgatttcaaaccccaggtggttactggagcccatacctaggaaaggaggcaaggatgtattccaggctcatagttggaagaaacgtgccttgagtctcagattttggaattttgagttgatgctgaaatgagttgagacttttggggaactattgggaagggatgcttgtattctgcagtgcaaaaaggatgtgagatttgttggggggtcatgggcagaa

SEQ ID NO: 1352 - DNA, 267 bp, Artificial Sequence
  Synthetic polypeptide
atgacactggcaactgacggcactgcggatatgtttggaataaggttcaaaagaagaggctgttctaagaaagactaccgagtaatcaatcacctcctcagagaaagtctgctcaggaaactctcctcccaccagcccctgcacttggttccttgcgttgcctctggctggaagctgttgtccccaacttcagaaagtgtctgcagatttcacaggctctctcttgggtcaagattgcacattccccaggggaagtacctggtgcct

SEQ ID NO: 1353 - DNA, 2187 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgttacctgggtcaaccatggtccaagaatatcaaatggaaaattccagaaataaacaatttgtaagttttaaattgcccactcttcagagtggtgtgatgaaatctcgtgttgtcctgctccatcctgcctgggatatgaatcctccctttatgctgcgtacccacggtgtataccctccccatcc

SEQ ID NO: 1354 - DNA, 2100 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgttacctgggtcaaccatggtccaagaatatcaaatggaaaattccagaaataaacaatttgtaagttttaaattgcccactcttcagagtggtgtgatgaaatctcgtgttgtcctgctccatcctgcctgggatatgaatcctccctttatgctgcgtacccacggtgtataccctccccatcc

SEQ ID NO: 1355 - DNA, 1722 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgttacctgggtcaaccatggtccaagaatatcaaatggaaaattccagaaataaacaatttgtaagttttaaattgcccactcttcagagtggtgtgatgaaatctcgtgttgtcctgctccatcctgcctgggatatgaatcctccctttatgctgcgtacccacggtgtataccctccccatcc

SEQ ID NO: 1356 - DNA, 4120 bp, Artificial Sequence
  Synthetic polypeptide
atgtctcagcaccagctccgcgtgccgcagcccgagggcctgggccgaaagagaaccagctcggaggacaacctgtacctggctgtgctcagggcctctgagggcaagaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1357 - DNA, 4132 bp, Artificial Sequence
  Synthetic polypeptide
atgtcgggggcggggggcgcctttgcctcgccgagggaggtcttgctggagcggccgtgctggctggacgggggctgcgagccggcccgcaggggctacctctaccagcagctgtgctgcgtagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1358 - DNA, 4120 bp, Artificial Sequence
  Synthetic polypeptide
atggagccctcgggcagcctgtttccctccctggtggttgtgggtcacgttgtcaccctggccgctgtgtggcactggcgcaggggacgtcggtgggcgcaggacgagcaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1359 - DNA, 4024 bp, Artificial Sequence
  Synthetic polypeptide
atgaagatcgtgcccgatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1360 - DNA, 4531 bp, Artificial Sequence
  Synthetic polypeptide
atggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1361 - DNA, 4054 bp, Artificial Sequence
  Synthetic polypeptide
atggacccctcgcgagccatccagaacgagatcagctccctcaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1362 - DNA, 4078 bp, Artificial Sequence
  Synthetic polypeptide
atggccggcccgctgcccgacgagcaggacttcatccaggcctacgaggaggtgcgcgagaagtacaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1363 - DNA, 4201 bp, Artificial Sequence
  Synthetic polypeptide
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1364 - DNA, 4189 bp, Artificial Sequence
  Synthetic polypeptide
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1365 - DNA, 210 bp, Artificial Sequence
  Synthetic polypeptide
aggtccagtcgggatcagagagtgtcatccaggagtacgtggacctgcgtacgcactacagcgagctgaccacactgacgagccagtacatcaagttcatcagcgagactctgcggcgcatggaggaggaggagatgggccgctgggtaaccaaacagcatgagagggaggtttgtcatcgcggaagtattccagccagtgaacaaagaa

SEQ ID NO: 1366 - DNA, 718 bp, Artificial Sequence
  Synthetic polypeptide
atgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaacttcctctgaacttc

SEQ ID NO: 1367 - DNA, 720 bp, Artificial Sequence
  Synthetic polypeptide
aggcacctctggggtggcacctggcacaacagttgcccctggaagtttcagcacagcagctacaacttctcctggagcaagtggagtgactggcactggacccactgcagagaccacaactttcctaggaggaagtagcaccactggagcagaaataaaatcaggagccaccactggagcaccaggaagtaagacaggcacagctaaagtgctctctggtacgacagttgcctctgggagctccaactcagaggctacaactttctctggaatcactgaagcagtaacagtcccaagtaaaaatggatctatgaccactgcactggggagccaactctccagcagtcaaacagtgattccaggttccagtggcaccatctctcacacaactgttgcacctggaagttctgttacaggaaccaccactggtgcatcagatgatcaagtcactggaagtaaaacaggcactactggtgtggccttgagcacaactgttgcacctggaagttccagtacagaagccacaacttccacaggagtccatagaaccactgtagtgggacagaagacaggagctaccactagagggtcagcaaagcaaggaactagaagcacaatagctattcaggaggctgaggcaggaggatcacttgaacctggatggaggttgcagtgagagatagcaccattgcactccagcctgggtgacagagagagact

SEQ ID NO: 1368 - DNA, 281 bp, Artificial Sequence
  Synthetic polypeptide
atgcggctgctgcccctgctgcggactgtcctctgggccgcgttcctcggctcccctctgcgcgggggctccagcctccgccacgtagtctactggaactccagtaaccccagtgtcagccctgcccttctagccgaatcacctctgggcaagtctcgtgaccttcctaacctcatttatctcacctgtataatgggctaataatacctagtaccctgggaagtctggcagggtaagtgaggtcatgtatgtgaaagaggctcaggctgtacagatataaa

SEQ ID NO: 1369 - DNA, 573 bp, Artificial Sequence
  Synthetic polypeptide
atggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactggtgaaaccccatctctactaaaaagcaaaaattagctgggtgtggtggcatgtgcctgtaatcccacctactcaggaggctgaggcaggagaatcccttgaacctgggtggcagaggttgcagtgagctgagattacgccactacactccagcctgggcgacagagcaagacttcgtgtcaaaaaaaaaaaaaaagaaaaaaaaaaaaa

SEQ ID NO: 1370 - DNA, 416 bp, Artificial Sequence
  Synthetic polypeptide
ggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactggtgaaaccccatctctactaaaaagcaaaaattagctgggtgtggtggcatgtgcctgtaatcccacctactcaggaggctgaggcaggagaatcccttgaacctgggtggcagaggttgcagtgagctgagattacgccactacactccagcctgggcgacagagcaagacttcgtgtcaaaaaaaaaaaaaaagaaaaaaaaaaaaa

SEQ ID NO: 1371 - DNA, 6019 bp, Artificial Sequence
  Synthetic polypeptide
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaccacagtgcaataaaactagaactcaggattaagaacctcactcaaaaccacttaactacatggaaactgaacaacctcctccagaatgactactgggtacataacgaaatcaaggcagaaataaatatgttctttgaaaccgatgagaacaaaggcaccacataccagaatctgtgggacacatttaaagcagtgtgtagagggaaatttatagcactaaatgcccacaagagaaagcaggaaagatctaaaattgatacactaacatcacaattaaaagaactagagaagcaagagcaaacacattcaaaagctagcagaaggcaagaaataactaaaatcagagcagaattgaaggagatagagacacaaaaaatccttcaaaaaatcaatgaatccaggagctggttttttgaaaagattaacaaatatgatagactgctagcaagactaataaagaagaaaagtgagaagaatcaaatagacacaataaaaaatgataaaggggatatcaccaccgatcccacagaaatacaaactaccatcagagaatactataaacacctctatgcaaataaactggagaatctagaaaaaatggataaattcctggacagctacaccctcccaagactaaaccaggaaggagaatccccgaatagaccaataacaggctctgtaattgaggcaataattaatagcctaccaaccaagaaaagtccaggactggacagattcccagccaaattctaccagaggtacaaggaggagctgataccattccttctgaaatgattccaatcaatagaaaaagagggaatcctccctaactcattttatgaggccagcatcatcctgataccaaagcctggcagagacacaacaaaaaaacagaattttagaccagtatccctgatgaacatcaatgcaaaaatcctcaataaaatactggcaaaccgaatccagcagcacatcagaaagcttatccaccatgatcaagttggcttcatccctgggatgcaaggctggttcaagatatgcaaatcaataaatataattcatcatataaacagaaccaaaaacaaaaaccacatgattatctcaatagatgcagaaaaggcctttgacaaaattcaacagcacttcatgctaaaaactctcaataaactaggtattgatgggatgtatctcaaaataataagatctatttatgacaaacccacagccagtatcataccgaatgggcaaaaactggaagcattccctttgaaaactggcacaagacagggatgccctctctcaccactgctattcaacatagtgttggaagttctggccagggcaatcacacaggagaaagaaatgaatggtattcaataaggaatagaggaagtcaaattttccctgtttgcagatgacatgattgtatatttagaaaaccccattgtctcagcccgaaatcttcttaagctgatataagcagcatcagcaaagtctcaggatacataataaatgtgcaaaaatcacaagcactcttatacaccaataacagacaaacagagaaccaaatcatgagtgaactcccattcacaattgcttcaaagagaataaaatatctaggaatccaacttacaagggatgtgaaggacctcttcaaggagaactatacaccactgcttaacgaaataaaagaggacacaaacaaatggaagagcattccatgcttatggataggaagaatcaatatcgtgaaaatggccatactgcccaaggtaatttatggattcaatgccatccccattaagctaccaatgactttcttcacagaattggaaaaactactttaaagttcatatggaaccaaaaaagagcctgcagtgccaagacgatcctaagccaaaataacaaagctggaggcatcacactacctgacttcaaactatactacaaggctacagtaaccaaaacagcatggtattagtaccaaaacagagatatagatgaatggaacagaaccacacatctacaaccatctgatctttgatgaaccagacaaaaacaagaaatggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaaccctagaagaaaacctaggcaataccattcaggacaaaggcatgggcaaagtcttcatgactaaaacaccaaaagcaatggcaacaaaagccaaaattgacaaatgggatctaattaaactaaagagcttcttctgcacagcaaaagaaactaccatgagaatgaacaggcaacctttttgcaatctacccatctgacaaagggctaatatccagaatctacaaaaacttaagtttacaagaaaaaatcaaacaccccatgaaaaagtgggcaaaggatatgaacagacacttctcaaaagaagatatttatgcagacaacagacacatgaaaaaatcctcatcatcacctgtcatcagagaaatgcaaatcaaaaccatgatgagatatcatctcacaccagttagaatggcgatcattaaaaagtcaggaaacaacaggtgctggagaggatgtggagaaataggaacgcttttacactgttggtgggagtgtaaactagttcaaccattgtggaagacagtgtggtgattcctgaaggatctagaactagaaataccatttgacccagggatcccattactggttatatacccaaaggattataaatcgtgctactgtaaagacacatgcacacatatgtttattgcagcactcttcacaatagcaaagacttggaactaacccaaatatacatcaatgatagactggattaagaaaatgtggcacatatacaccatggaattctctgcagccataaaaaaggatgtgttcatatcctttgtagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1372 - DNA, 6376 bp, Artificial Sequence
  Synthetic polypeptide
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaccacagtgcaataaaactagaactcaggattaagaacctcactcaaaaccacttaactacatggaaactgaacaacctcctccagaatgactactgggtacataacgaaatcaaggcagaaataaatatgttctttgaaaccgatgagaacaaaggcaccacataccagaatctgtgggacacatttaaagcagtgtgtagagggaaatttatagcactaaatgcccacaagagaaagcaggaaagatctaaaattgatacactaacatcacaattaaaagaactagagaagcaagagcaaacacattcaaaagctagcagaaggcaagaaataactaaaatcagagcagaattgaaggagatagagacacaaaaaatccttcaaaaaatcaatgaatccaggagctggttttttgaaaagattaacaaatatgatagactgctagcaagactaataaagaagaaaagtgagaagaatcaaatagacacaataaaaaatgataaaggggatatcaccaccgatcccacagaaatacaaactaccatcagagaatactataaacacctctatgcaaataaactggagaatctagaaaaaatggataaattcctggacagctacaccctcccaagactaaaccaggaaggagaatccccgaatagaccaataacaggctctgtaattgaggcaataattaatagcctaccaaccaagaaaagtccaggactggacagattcccagccaaattctaccagaggtacaaggaggagctgataccattccttctgaaatgattccaatcaatagaaaaagagggaatcctccctaactcattttatgaggccagcatcatcctgataccaaagcctggcagagacacaacaaaaaaacagaattttagaccagtatccctgatgaacatcaatgcaaaaatcctcaataaaatactggcaaaccgaatccagcagcacatcagaaagcttatccaccatgatcaagttggcttcatccctgggatgcaaggctggttcaagatatgcaaatcaataaatataattcatcatataaacagaaccaaaaacaaaaaccacatgattatctcaatagatgcagaaaaggcctttgacaaaattcaacagcacttcatgctaaaaactctcaataaactaggtattgatgggatgtatctcaaaataataagatctatttatgacaaacccacagccagtatcataccgaatgggcaaaaactggaagcattccctttgaaaactggcacaagacagggatgccctctctcaccactgctattcaacatagtgttggaagttctggccagggcaatcacacaggagaaagaaatgaatggtattcaataaggaatagaggaagtcaaattttccctgtttgcagatgacatgattgtatatttagaaaaccccattgtctcagcccgaaatcttcttaagctgatataagcagcatcagcaaagtctcaggatacataataaatgtgcaaaaatcacaagcactcttatacaccaataacagacaaacagagaaccaaatcatgagtgaactcccattcacaattgcttcaaagagaataaaatatctaggaatccaacttacaagggatgtgaaggacctcttcaaggagaactatacaccactgcttaacgaaataaaagaggacacaaacaaatggaagagcattccatgcttatggataggaagaatcaatatcgtgaaaatggccatactgcccaaggtaatttatggattcaatgccatccccattaagctaccaatgactttcttcacagaattggaaaaactactttaaagttcatatggaaccaaaaaagagcctgcagtgccaagacgatcctaagccaaaataacaaagctggaggcatcacactacctgacttcaaactatactacaaggctacagtaaccaaaacagcatggtattagtaccaaaacagagatatagatgaatggaacagaaccacacatctacaaccatctgatctttgatgaaccagacaaaaacaagaaatggggaaaggattccctatttaataaatggtgctgggaaaactggctagccatatgtagaaagctgaaactggatcccttccttacaacttatacaaaaattaattcaagatggattaaagacttaaatgttagacctaaaaccataaaaaccctagaagaaaacctaggcaataccattcaggacaaaggcatgggcaaagtcttcatgactaaaacaccaaaagcaatggcaacaaaagccaaaattgacaaatgggatctaattaaactaaagagcttcttctgcacagcaaaagaaactaccatgagaatgaacaggcaacctttttgcaatctacccatctgacaaagggctaatatccagaatctacaaaaacttaagtttacaagaaaaaatcaaacaccccatgaaaaagtgggcaaaggatatgaacagacacttctcaaaagaagatatttatgcagacaacagacacatgaaaaaatcctcatcatcacctgtcatcagagaaatgcaaatcaaaaccatgatgagatatcatctcacaccagttagaatggcgatcattaaaaagtcaggaaacaacaggtgctggagaggatgtggagaaataggaacgcttttacactgttggtgggagtgtaaactagttcaaccattgtggaagacagtgtggtgattcctgaaggatctagaactagaaataccatttgacccagggatcccattactggttatatacccaaaggattataaatcgtgctactgtaaagacacatgcacacatatgtttattgcagcactcttcacaatagcaaagacttggaactaacccaaatatacatcaatgatagactggattaagaaaatgtggcacatatacaccatggaattctctgcagccataaaaaaggatgtgttcatatcctttgtagggacatggatgaagctggaaaccatcattctgagcaaactatcgcaaggacagaaaaccaaacatcacatgttctcacccataggtgggaattgaacaatgagaacacttggacacaggaagtgcaacatcacacacgggggcctgtcatggggtggggggaggtgggagggatagcattaagagaaatacctaatgtaaatgacgagttaatgggtgcagtgcaccaatatggcacatgtatacatatgtaaaaaacctgcacgttgtgcagatgtactctagaacttaatgtataataacaacaaaaaaa

SEQ ID NO: 1373 - DNA, 1348 bp, Artificial Sequence
  Synthetic polypeptide
atgtctcgatcacgacaacccccccttgtgaccggcatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagtgctctggatgatcagccacactgcctccttcaaggccaccagcgatagtcactgtacgtctgttaccagttctcagcagacagcaaagtgtgcagttgtgctacctccttatctcccagtgacaaaccctcctgacattttacaaaaatggatgatcgggaagggattggtcgataaagatgaaagtgcatcaaaaaccaggaagctctaacactggaagtgaaacgcaaatccaccaaatggagagtgacggaaggaatagctggctgtggggatgtaggtcctcctgtctttgagactcaagagtaactcagtggaggggaacttcccaacaaaggtgagcaaatgtgaagaaaagcatgagatgtcccaaaggaagcaatgctcagagaacctcagagatgtttcatgatgtggacggtgcaaaggaaaaaatatcagaagttgattcacgcttagaaaggagcaggataatctgtcagagcacagaaaagaggcttgattcatattgtaaatattacaacaaaaaagaaggcaaacactcttgataagtttttctacaaagaaatatgacgctttaattttaaatgtttctgatgtttta

SEQ ID NO: 1374 - DNA, 857 bp, Artificial Sequence
  Synthetic polypeptide
atgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagatcgaagagctggagctccagtgggcatcttgggccctgagatgacattggggaaagaaagttttctggaacaaggtgacactgtgggcacaaaaactatcccaactctagacttcttgagtgtaaaagacatatcgacttctatcttgtttaagccactattactacgagattttttcttttacaatcaaatctaa

SEQ ID NO: 1375 - DNA, 559 bp, Artificial Sequence
  Synthetic polypeptide
atgcgcttgctccagctcctgttcagggccagccctgccaccctgctcctggttctctgcctgcagttgggggccaacaaagctcaggacaacactcggaagatcataataaagaattttgacattcccaagtcagtacgtccaaatgacgaagtcactgcagtgcttgcagttcaaacagaattgaaagaatgcatggtggttggatgaagcaaactaccattctggaaagacccagatggcaagaaattgaaggtggcctctaaccaacagctagcaaggaactgaggccctcagtccaaaacccacagggaactgaatgctgccaacaaccatgtgggcttggaaacatgcccttccatcattaagccttcagaaagaacgtatccctggcaaacacctggattgtagcctgtgaaaaatgctgaagcagaggacccagttaatctgtgcccaaaattcttgaccccagaaactgaaagataataaatgtgtgtgcatgttttttaaggcactgcatttgtggtaattcattatgcaccaatagataactaataca

SEQ ID NO: 1376 - DNA, 610 bp, Artificial Sequence; identical to SEQ ID NO: 163
  Synthetic polypeptide

SEQ ID NO: 1377 - DNA, 1052 bp, Artificial Sequence; identical to SEQ ID NO: 247
  Synthetic polypeptide

SEQ ID NO: 1378 - DNA, 327 bp, Artificial Sequence; identical to SEQ ID NO: 246
  Synthetic polypeptide

SEQ ID NO: 1379 - DNA, 506 bp, Artificial Sequence; identical to SEQ ID NO: 1096
  Synthetic polypeptide

SEQ ID NO: 1380 - DNA, 1216 bp, Artificial Sequence
  Synthetic polypeptide
atggctctggcccgaggcagccggcagctgggggccctggtgtggggcgcctgcctgtgcgtgctggtgcacgggcagcaggcgcagcccgggcagggctcggaccccgcccgctggcggcagctgatccagtgggagaacaacgggcaggtgtacagcttgctcaactcgggctcagagtacgtgccggccggacctcagcgctccgagagtagctcccgggtgctgctggccggcgcgccccaggcccagcagcggcgcagccacgggagcccccggcgtcggcaggcgccgtccctgcccctgccggggcgcgtgggctcggacaccgtgcgcggccaggcgcggcacccattcggctttggccaggtgcccgacaactggcgcgaggtggccgtcggggacagcacgggcatggcccgggcccgcacctccgtctcccagcaacggcacgggggctccgcctcctcggtctcggcttcggccttcgccagcacctaccgccagcagccctcctacccgcagcagttcccctacccgcaggcgcccttcgtcagccagtacgagaactacgaccccgcgtcgcggacctacgaccagggtttcgtgtactaccggcccgcgggcggcggcgtgggcgcgggggcggcggccgtggcctcggcgggggtcatctacccctaccagccccgggcgcgctacgaggagtacggcggcggcgaagagctgcccgagtacccgcctcagggcttctacccggcccccgagaggccctacgtgccgccgccgccgccgccccccgacggcctggaccgccgctactcgcacagtctgtacagcgagggcacccccggcttcgagcaggcctaccctgaccccggtcccgaggcggcgcaggcccatggcggagacccacgcctgggctggtacccgccctacgccaacccgccgcccgaggcgtacgggccgccgcgcgcgctggagccgccctacctgccggtgcgcagctccgacacgcccccgccgggtggggagcggaacggcgcgcagcagggccgcctcagcgtgggcagcgtgtaccggcccaaccagaacggccgcggtctttgttcatgctgttttccctgccgtggacaccctttcccgctctctgattctctaaatcctgccccatctcccagatcttgttcatgtccaagcttttccaggaagtctt

SEQ ID NO: 1381 - DNA, 1363 bp, Artificial Sequence; identical to SEQ ID NO: 209
  Synthetic polypeptide

SEQ ID NO: 1382 - DNA, 2101 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggcccagagctccccggagtgagactgacctcattcatctccctgtcctcagcacctggcatagtatctggcttgtggtgggcactaaaatgttggttga

SEQ ID NO: 1383 - DNA, 2014 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggcccagagctccccggagtgagactgacctcattcatctccctgtcctcagcacctggcatagtatctggcttgtggtgggcactaaaatgttggttga

SEQ ID NO: 1384 - DNA, 1636 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggcccagagctccccggagtgagactgacctcattcatctccctgtcctcagcacctggcatagtatctggcttgtggtgggcactaaaatgttggttga

SEQ ID NO: 1385 - DNA, 1654 bp, Artificial Sequence
  Synthetic polypeptide
atgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttgctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgagggaattaaatttcctagactcgtttgctttctggagttggctaataggaggcactaacagaagattggagggtgagaggagggaagaagccagggtctttccccagtccctttttgagccaactccagcagcagctcccttgtgtcctattaacacagccccttcctcatggtcccagttactactgagcagatcctgctatggttctagcaccatcctgagcttctgggatatggtgagactacatcatcttattgtcctttcagtgctagaagtcatagaagctccctgctattactagtctctgggtttcctcactttcctctgttttgtataaccggttctctatagtgaatttcttctgtgtgaaa

SEQ ID NO: 1386 - DNA, 632 bp, Artificial Sequence
  Synthetic polypeptide
tgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagaggaagtattctgcttcatcaggtggtctatgcgaagaagcgacagctgctaaagtggcatcctgggattttgttgaagccacacaaagaacaaattgcagttgtttgagggaattaaatttcctagactcgtttgctttctggagttggctaataggaggcactaacagaagattggagggtgagaggagggaagaagccagggtctttccccagtccctttttgagccaactccagcagcagctcccttgtgtcctattaacacagccccttcctcatggtcccagttactactgagcagatcctgctatggttctagcaccatcctgagcttctgggatatggtgagactacatcatcttattgtcctttcagtgctagaagtcatagaagctccctgctattactagtctctgggtttcctcactttcctctgttttgtataaccggttctctatagtgaatttcttctgtgtgaaa

SEQ ID NO: 1387 - DNA, 756 bp, Artificial Sequence
  Synthetic polypeptide
atgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggcagtatgatcttgtatgtagaagacctggaagaatctacaaagaagctaccagaataagtgagtttatcaaggtctcaagatcaatgtataaaaacggttatctttcgttatactgcaaatacacaattggaaaatgaaattttaaaacttctgtttatagtagcacccaaaacttgaattactcagg

SEQ ID NO: 1388 - DNA, 1389 bp, Artificial Sequence
  Synthetic polypeptide
atgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccattaaatgctgctcgttgccaagatgaaaaggcacaccttccaaccatgaaatcctttggtactcacaggagagtgacccacaaaccaaatctgttgggttctaaatggtttataaaaatattaaagaggcatttctcatctgtatcaacggaaacatttgttccaaaacaagacttcccacaggtgaagagaccactaaaagcatccaggaccagacagccatccaggaccaaccttccagttctgtctgtgaacgaggacctaatgcactgcacagcatttgcaacggcagatgagtatcatctgggaaatctgtctcaagatctggcctcccacggatatgttgaagtaacaagcttgcctagagatgcagcaaatattttggtgatgggtgtggaaaattctgcaaaagaaggtgatcctggaacaatattcttcttcagggaaggagctgctgtgttttggaatgtgaaagacaaaactatgaagcatgtgatgaaagttctagaaaaacatgaaattcagccctatgaaatcgcactggtacactgggaaaatgaagaacttaactacataaaaatagagggacagtcaaaacttcacaggggggaaatcaagttaaattcagagctggatttagatgatgccattctagagaagtttgctttctccaatgctctatgcctttctgtaaaactggcaatttgggaagcatcactggataaatttattgaatctattcagtcaattcctgaggctttaaaagctgggaagaaagtgaaactatctcatgaagaagttatgcagaaaatcggtgaactctttgctctaaggcaccgtataaacttgagttcagacttcctgattactcctgatttctactgggacagagaaaacctggaaggactttacgataaaacgtgtcaattccttagcattggccgaagagttaaggcagtatgatcttgtatgtagaagacctggaagaatctacaaagaagctaccagaataagtgagtttatcaaggtctcaagatcaatgtataaaaacggttatctttcgttatactgcaaatacacaattggaaaatgaaattttaaaacttctgtttatagtagcacccaaaacttgaattactcagg

SEQ ID NO: 1389 - DNA, 1370 bp, Artificial Sequence
  Synthetic polypeptide
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagccactccaacattcagcaaccagcacgctgatcagtcagcagccatcaacatcgagacaagaccctccaccaacaaaaagattacaacttgctgaaggctcagatgatccttagcatttttcagcaacaaagtatttttcagtaagtaatgttcatgtattttagacataattctgttgaacacttaatagactatagtgtacacataacttttata

SEQ ID NO: 1390 - DNA, 3174 bp, Artificial Sequence
  Synthetic polypeptide
atgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1391 - DNA, 3024 bp, Artificial Sequence
  Synthetic polypeptide
atgctatcgggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1392 - DNA, 3081 bp, Artificial Sequence
  Synthetic polypeptide
atggctgatggaggcgctgattcggcagcgcaaagacttccagaaggcccgggcagagtagccccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1393 - DNA, 2985 bp, Artificial Sequence
  Synthetic polypeptide
atgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1394 - DNA, 2775 bp, Artificial Sequence
  Synthetic polypeptide
atgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1395 - DNA, 2949 bp, Artificial Sequence
  Synthetic polypeptide
atgcctgcttcaatctcctccatcttcccaggtccaactctgcttttgtcttgtggctcagaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1396 - DNA, 1590 bp, Artificial Sequence
  Synthetic polypeptide
atgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1397 - DNA, 849 bp, Artificial Sequence
  Synthetic polypeptide
atggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggaggtgcagcttatttcctcttgccttgagtgtgctctggacttggggacctccttcttacggactatggaaagaaaaaaacagtaactttacagtagagaaacctcacaaacaccacctgaaccgaatggtcaagatgaagatcaccagcaataaatcatgttgacatcatgtgcccccatatactgcaacgagaagcgcacatcacctttgtgctactcctgccaaaatcaacaaccttagtcttttcatgagaaaacaccagacaatcccagattgggggaccttctacaaaatacctaaccatgagtcttaaaaagtgttgaaatttaaattaaaaaaaa

SEQ ID NO: 1398 - DNA, 2911 bp, Artificial Sequence
  Synthetic polypeptide
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaattggaaaaactactttaaagttcatatggaaccaaaaaagagcccgcattgtcaagtcaatcctaagccaaaagaacaaagctgcaggcatcacgctacctgacttcaaactataccacaaggctacagtaaccaaaacagcatggtactggtaccaaaacagagatatagaccaatggaatagaacagagtcctcagaaataacgtc

SEQ ID NO: 1399 - DNA, 3268 bp, Artificial Sequence
  Synthetic polypeptide
atgacaaagaggaagaagaccatcaaccttaatatacaagacgcccagaagaggactgctctacactgggcctgtgtcaatggccatgaggaagtagtaacatttctggtagacagaaagtgccagcttgacgtccttgatggcgaacacaggacacctctgatgaaggctctacaatgccatcaggaggcttgtgcaaatattctgatagattctggtgccgatataaatctcgtagatgtgtatggcaacacggctctccattatgctgtttatagtgagattttgtcagtggtggcaaaactgctgtcccatggtgcagtcatcgaagtgcacaacaaggctagcctcacaccacttttactatccataacgaaaagaagtgagcaaattgtggaatttttgctgataaaaaatgcaaatgcgaatgcagttaataagtataaatgcacagccctcatgcttgctgtatgtcatggatcatcagagatagttggcatgcttcttcagcaaaatgttgacgtctttgctgcagatatatgtggagtaactgcagaacattatgctgttacttgtggatttcatcacattcatgaacaaattatggaatatatacgaaaattatctaaaaatcatcaaaataccaatccagaaggaacatctgcaggaacacctgatgaggctgcacccttggcggaaagaacacctgacacagctgaaagcttggtggaaaaaacacctgatgaggctgcacccttggtggaaagaacacctgacacggctgaaagcttggtggaaaaaacacctgatgaggctgcatccttggtggagggaacatctgacaaaattcaatgtttggagaaagcgacatctggaaagttcgaacagtcagcagaagaaacacctagggaaattacgagtcctgcaaaagaaacatctgagaaatttacgtggccagcaaaaggaagacctaggaagatcgcatgggagaaaaaagaagacacacctagggaaattatgagtcccgcaaaagaaacatctgagaaatttacgtgggcagcaaaaggaagacctaggaagatcgcatgggagaaaaaagaaacacctgtaaagactggatgcgtggcaagagtaacatctaataaaactaaagttttggaaaaaggaagatctaagatgattgcatgtcctacaaaagaatcatctacaaaagcaagtgccaatgatcagaggttcccatcagaatccaaacaagaggaagatgaagaatattcttgtgattctcggagtctctttgagagttctgcaaagattcaagtgtgtatacctgagtctatatatcaaaaagtaatggagataaatagagaagtagaagagcctcctaagaagccatctgccttcaagcctgccattgaaatgcaaaactctgttccaaataaagcctttgaattgaagaatgaacaaacattgagagcagatccgatgttcccaccagaatccaaacaaaaggactatgaagaaaattcttgggattctgagagtctctgtgagactgtttcacagaaggatgtgtgtttacccaaggctacacatcaaaaagaaatagataaaataaatggaaaattagaagagtctcctaataaagatggtcttctgaaggctacctgcggaatgaaagtttctattccaactaaagccttagaattgaaggacatgcaaactttcaaagcagagcctccggggaagccatctgccttcgagcctgccactgaaatgcaaaagtctgtcccaaataaagccttggaattgaaaaatgaacaaacattgagagcagatgagatactcccatcagaatccaaacaaaaggactatgaagaaaattcttgggatactgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctgcgcatcaaaaagaaatagataaaataaatggaaaattagaagggtctcctgttaaagatggtcttctgaaggctaactgcggaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatgagatactcccatcagaatccaaacaaaaggactatgaagaaagttcttgggattctgagagtctctgtgagactgtttcacagaaggatgtgtgtttacccaaggctacgcatcaaaaagaaatagataaaataaatggaaaattagaagagtctcctgataatgatggttttctgaaggctccctgcagaatgaaagtttctattccaactaaagccttagaattgatggacatgcaaactttcaaagcagagcctcccgagaagccatctgccttcgagcctgccattgaaatgcaaaagtctgttccaaataaagccttggaattgaagaatgaacaaacattgagagcagatcagatgttcccttcagaatcaaaacaaaagaaggttgaagaaaattcttgggattctgagagtctccgtgagactgtttcacagaaggatgtgtgtgtacccaaggctacacatcaaaaagaaatggataaaataagtggaaaattagaagaattggaaaaactactttaaagttcatatggaaccaaaaaagagcccgcattgtcaagtcaatcctaagccaaaagaacaaagctgcaggcatcacgctacctgacttcaaactataccacaaggctacagtaaccaaaacagcatggtactggtaccaaaacagagatatagaccaatggaatagaacagagtcctcagaaataacgtc

SEQ ID NO: 1400 - DNA, 393 bp, Artificial Sequence
  Synthetic polypeptide
atgtcacactacttctacttgactccacaaattcttctgccctttagccctcttacttctcaagagtttgatctgatcagacgcaaggctggagcatcttggcaggatgaaacacgatggtcagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaagactcagcccacctgcacccaggtgattaaaagctttattgctcacacaaagcctgtttggtggtctcttcacacggatgcgcaaga

SEQ ID NO: 1401 - DNA, 272 bp, Artificial Sequence
  Synthetic polypeptide
cagattcttccgtgacaacatacacaggcagttaccggaaaaaacaactggacaagtccatgtgcagccaattttcttttagagcaggacagcatgagcctgagtgtaaacagatgtcattgacaaacagttctgcctgtcatcttctctgctgggctggtacccaagagactacagatatcaaagactcagcccacctgcacccaggtgattaaaagctttattgctcacacaaagcctgtttggtggtctcttcacacggatgcgcaaga

SEQ ID NO: 1402 - DNA, 5853 bp, Artificial Sequence; identical to SEQ ID NO: 376
  Synthetic polypeptide

SEQ ID NO: 1403 - DNA, 5829 bp, Artificial Sequence; identical to SEQ ID NO: 377
  Synthetic polypeptide

SEQ ID NO: 1404 - DNA, 1950 bp, Artificial Sequence; identical to SEQ ID NO: 378
  Synthetic polypeptide

SEQ ID NO: 1405 - DNA, 2072 bp, Artificial Sequence; identical to SEQ ID NO: 379
  Synthetic polypeptide

SEQ ID NO: 1406 - DNA, 1120 bp, Artificial Sequence
  Synthetic polypeptide
atgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaa

SEQ ID NO: 1407 - DNA, 601 bp, Artificial Sequence
  Synthetic polypeptide
atggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgtaaatgctacgaagtgggaatgatgaaaggtgggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaa

SEQ ID NO: 1408 - DNA, 475 bp, Artificial Sequence
  Synthetic polypeptide
cataacgactatatgtgtccagccaccaaccagtgcaccattgataaaaacaggaggaagagctgccaggcctgccggctccgtaaatgctacgaagtgggaatgatgaaaggtgggacatggatgaagccagaagccatcattctcagcaaactaacacaggaacagaaaaccaaacacctcatgttcgcactcataagtgggagttgaacaatgagaacacatggacacagggagtggagcatcacacaacggggcctgtcgggagttgggggactaggggagggagagcattaggacaaatacctaatgcatgtggggcttaaaacctagatgacgggttgataggtgtagcaaaccaccatggcacatgtatacctatgtaacaaacctgcacgttctgcacatatatcccagaactaaaagtaaaataaatgaaaaagaaataaaaaataataaaataaaataaaataaa

SEQ ID NO: 1409 - DNA, 1883 bp, Artificial Sequence
  Synthetic polypeptide
atggcgagcctcgccgcgctcgccctcagcctgctcctgaggctgcagctgccgccactgcccggcgcccgggctcagagcgccgcaggtggctgttcctttgatgagcactacagcaactgtggttatagtgtggctctagggaccaatgggttcacctgggagcagattaacacatgggagaaaccaatgctggaccaggcagtgcccacaggatctttcatgatggtgaacagctctgggagagcctctggccagaaggcccaccttctcctgccaaccctgaaggagaatgacacccactgcatcgacttccattactacttctccagccgtgacaggtccagcccaggggccttgaacgtctacgtgaaggtgaatggtggcccccaagggaaccctgtgtggaatgtgtccggggtcgtcactgagggctgggtgaaggcagagctcgccatcagcactttctggccacatttctatcaggtgatatttgaatccgtctcattgaagggtcatcctggctacatcgccgtggacgaggtccgggtccttgctcatccatgcagaaaagcacctcattttctgcgactccaaaacgtggaggtgaatgtggggcagaatgccacatttcagtgcattgctggtgggaagtggtctcagcatgacaagctttggctccagcaatggaatggcagggacacggccctgatggtcacccgtgtggtcaaccacaggcgcttctcagccacagtcagtgtggcagacactgcccagcggagcgtcagcaagtaccgctgtgtgatccgctctgatggtgggtctggtgtgtccaactacgcggagctgatcgtgaaagagcctcccacgcccattgctcccccagagctgctggctgtgggggccacatacctgtggatcaagccaaatgccaactccatcatcggggatggccccatcatcctgaaggaagtggaatatcgcaccaccacaggcacgtgggcagagacccacatagtcgactctcccaactataagctgtggcatctggaccccgatgttgagtatgagatccgagtgctcctcacacgaccaggtgaggggggtacgggaccgccagggcctcccctcaccaccaggaccaagtgtgcagatccggtacatggcccacagaacgtggaaatcgtagacatcagagcccggcagctgaccctgcagtgggagcccttcggctacgcggtgacccgctgccatagctacaacctcaccgtgcagtaccagtatgtgttcaaccagcagcagtacgaggccgaggaggtcatccagacctcctcccactacaccctgcgaggcctgcgccccttcatgaccatccggctgcgactcttgctgtctaaccccgagggccgaatggagagcgaggagctggtggtgcagactgaggaagacgcactgttcacaatagcaaagacatggagtcaacccaaatggccatcaatgatagactggataaagaaaatgtggtatttgcagccataaaaaggaatgagatcatgtcctttgcaggaacatggatggagctggaagtcattatcctcagcagactaacacaggaacagacaaccaaacactgcacgttctcacttgtaagtgggagctgaacaatgagaacacatggacacagggaggggaacagcacaccctggggcctgttgggggagtgtggggagggagagcatcaggataaatagttaatgcatatggggcttaatacctaggtgatgggttgataggtccagcaaactaccatggcatgcatttacctatgtaacaaacctgcagttcctgctcatgtatctcagaactttaaattaaattagaaa

SEQ ID NO: 1410 - DNA, 667 bp, Artificial Sequence
  Synthetic polypeptide
atgtcaacaattgggagttttgaaggattccaggctgtgtctctgaagcaagagggagatgaccaaccctctgagactgaccacctatcgatggaggaagaggacccgatgccaagacagatttcaaggcagtcaagtgtgaccgaatcaactctttaccccaatccttatcatcagccttatatctcacggaagtactttgctacacggccgggggccattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaaggcagttcctctgcacatgctcttttgcttgccaccatgtaagacgtccctttgctcctccttcaccttccgctatgattataaggcctccccagccacttagaaccgtgagtccattaaacttttttctttataaattacctagtcttgggtatttcttcatagcagtataaaaagggagtaataca

SEQ ID NO: 1411 - DNA, 449 bp, Artificial Sequence
  Synthetic polypeptide
cattgagactgccatggaagacttgaaaggtcacgtagctgagacttctggagagaccattcaaggcttctggctcttgacaaagatagaccactggaacaatgagaaggagagaattctactggtcacagacaagactctcttgatctgcaaatacgacttcatcatgctgagttgtgtgcagctgcagcggattcctctgagcgctgtctatcgcatctgcctgggcaagttcaccttccctgggatgtccctggacaaggcagttcctctgcacatgctcttttgcttgccaccatgtaagacgtccctttgctcctccttcaccttccgctatgattataaggcctccccagccacttagaaccgtgagtccattaaacttttttctttataaattacctagtcttgggtatttcttcatagcagtataaaaagggagtaataca

SEQ ID NO: 1412 - DNA, 729 bp, Artificial Sequence; identical to SEQ ID NO: 202
  Synthetic polypeptide

SEQ ID NO: 1413 - DNA, 644 bp, Artificial Sequence
  Synthetic polypeptide
atgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagaaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 1414 - DNA, 579 bp, Artificial Sequence
  Synthetic polypeptide
aaacatccagaatacatttccaacaagagcactggccaagtcaggatggggagatgacatcacttgggtacaaacttatgaagaaggtctcttttatgctcaaaaaagtaagaagccattaatggttattcatcacctggaggattgtcaatactctcaagcactaaagaaagtatttgcccaaaatgaagaaatacaagaaatggctcagaataagttcatcatgctaaaccttatgcatgaaaccactgataagaatttatcacctgatgggcaatatgtgcctagaatcatgtttgtagaaatttggatacagagacatgcatacagaaggaatgccatgtgagcaggaagcagagtgtgatcgtgcagcagaagccaaggaatgctcaaggttgtcagcaaacacactggatgacaggcacggaaaagattctccttcacagccctcggaaggaaccaaccctgccaacaccttgatctcagatctctaccctccagatctgtgagacaataaattgactgtttaagccactcaatgtgtggtgctttttatgacagctctagcaaaccaataca

SEQ ID NO: 1415 - DNA, 3157 bp, Artificial Sequence
  Synthetic polypeptide
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatc

SEQ ID NO: 1416 - DNA, 1375 bp, Artificial Sequence
  Synthetic polypeptide
atggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatc

SEQ ID NO: 1417 - DNA, 2851 bp, Artificial Sequence
  Synthetic polypeptide
atgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcaacactggaagccagaagacagtggagcagtgccttcagaatttgatggaaaagaaaatcttcaaagaatttcatacctagccaaaccatcaaacaagtacaatggcagcatgaaagtattttccaacttgcaaggtctcctagagtttacctcagatacaactttctcaagaactgctacaggatgtcttataacaaaacatgggattaagccaaagatccaccccaacagagatgcaaagtgatgtcccagaacaataactgtgcagagcagtagttagtctagatgggagcagtaatacaaagggttctaggataccagctccaggaaaaataaatggaactgagagattaccactaagtatgactgtaattgaggtgatttttacaattctgttgcagaatttgactatggctttgagacaaatatagagaaaacaaagcaaacaagaacacgaggtgattcacttttgcaaaataaaaataagtcgtaagaatggagatgcaatc

SEQ ID NO: 1418 - DNA, 604 bp, Artificial Sequence; identical to SEQ ID NO: 1194
  Synthetic polypeptide

SEQ ID NO: 1419 - DNA, 364 bp, Artificial Sequence; identical to SEQ ID NO: 1195
  Synthetic polypeptide

SEQ ID NO: 1420 - DNA, 565 bp, Artificial Sequence
  Synthetic polypeptide
atgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacagggcccagacagaagagaagagtcacatcatctagatgatgaatgaaaagatatgtcattattctcctttgggcagtgcttctgcagaaaagttgcaccttctaggtgttggactcagcaatatatcacaatgtctgcagtattttggaaggagaggagagtcaccattacttaggtgctaggcccagcaatacatctcaagcacttcttgggcaaagcccaagcagtaaaaaagagtcacattacctaggttctgggtatagcaatatgtcacaaatgcccctaagaagagggcccaggaaaagagagtcac

SEQ ID NO: 1421 - DNA, 64 bp, Artificial Sequence
  Synthetic polypeptide
atgcttcgcaaagttggtgagttccatgaggagactgcaacttctccaccctgtgcccctccag

SEQ ID NO: 1422 - DNA, 1068 bp, Artificial Sequence; identical to SEQ ID NO: 1221
  Synthetic polypeptide

SEQ ID NO: 1423 - DNA, 847 bp, Artificial Sequence
  Synthetic polypeptide
atgcctgaggatcaagttggaaaactagaagcaacagaaaacacaataagcgcaatggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1424 - DNA, 793 bp, Artificial Sequence
  Synthetic polypeptide
atggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1425 - DNA, 418 bp, Artificial Sequence
  Synthetic polypeptide
atggcggcggccgcggcggagcagcaacagttctacctgctcctgggaaacctgctcagccccgacaatgtggtccggaaacaggcagaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagaacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1426 - DNA, 798 bp, Artificial Sequence
  Synthetic polypeptide
ttttccggccattgctgccgcggcgcctggcaccagttacctccccgccgccgctcgcacccacgtgcggccgctcccgacgcgcccccgtccaggaaacctatgagaatatcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaatagatgaggatggcaataaccagtggcccgaaggtttgaagttcctttttgattcagtcagctctcaaaatgtgggactgcgggaagctgcccttcacattttctggaactttcctggaatttttgggaaccagcaacaacactatttagatgtcatcaaacgaatgttagttcagtgtatgcaagatcaggaacacccgtcgatcaggacgttatctgctagagctacagctgcatttatacttgcaaatgagcataatgttgctctgttcaaacattttgcagacttgctaccgggattcctacagttgagcatctcaagtcagaaatccgaaatactcaaatgcgcatttcctttgagtgacgtgtctgtgttcaaaaagttgaggatttcagagcattttggatttgggatgttccacctgtatgtat

SEQ ID NO: 1427 - DNA, 803 bp, Artificial Sequence; identical to SEQ ID NO: 152
  Synthetic polypeptide

SEQ ID NO: 1428 - DNA, 1296 bp, Artificial Sequence
  Synthetic polypeptide
atggccgacaaggaagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1429 - DNA, 1299 bp, Artificial Sequence
  Synthetic polypeptide
atggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1430 - DNA, 543 bp, Artificial Sequence
  Synthetic polypeptide
atgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1431 - DNA, 1194 bp, Artificial Sequence
  Synthetic polypeptide
atgacccatgctctggagtggcccagcctaactgcccagtggcttccagatgtaaccagaccagaagggaaagatttcagcattcatcgacttgtcctggggacacacacatcggatgaacaaaaccatcttgttatagccagtgtgcagctccctaatgatgatgctcagtttgatgcgtcacactacgacagtgagaaaggagaatttggaggttttggttcagttagtggaaaaattgaaatagaaatcaagatcaaccatgaaggagaagtaaacagggcccgttatatgccccagaacccttgtatcatcgcaacaaagactccttccagtgatgttcttgtttttgactatacaaaacatccttctaaaccagatccttctggagagtgcaacccagacttgcgtctccgtggacatcagaaggaaggctatgggctttcttggaacccaaatctcagtgggcacttacttagtgcttcagatgaccataccatctgcctgtgggacatcagtgccgttccaaaggagggaaaagtggtagatgcgaagaccatctttacagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1432 - DNA, 706 bp, Artificial Sequence
  Synthetic polypeptide
gaacccttgtatcatcgcaacaaagactccttccagtgatgttcttgtttttgactatacaaaacatccttctaaaccagggcatacggcagtagtagaagatgtttcctggcatctactccatgagtctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1433 - DNA, 578 bp, Artificial Sequence
  Synthetic polypeptide
ctctgtttgggtcagttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1434 - DNA, 564 bp, Artificial Sequence
  Synthetic polypeptide
gttgctgatgatcagaaacttatgatttgggatactcgttcaaacaatacttccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1435 - DNA, 513 bp, Artificial Sequence
  Synthetic polypeptide
tccaaaccaagccactcagttgatgctcacactgctgaagtgaactgcctttctttcaatccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcgcagactgaatgtctgggatttaagtaaaattggagaggaacaatccccagaagatgcagaagacgggccaccagagttgttgtttattcatggtggtcatactgccaagatatctgatttctcctggaatcccaatgaaccttgggtgatttgttctgtatcagaagacaatatcatgcaagtgtggcaaatggttgtctccggatactttcatccaagagttgaatagttgtaacacagattgtgtggcccaaaagctataaagtatttactctctggc

SEQ ID NO: 1436 - DNA, 1072 bp, Artificial Sequence; identical to SEQ ID NO: 307
  Synthetic polypeptide

SEQ ID NO: 1437 - DNA, 763 bp, Artificial Sequence; identical to SEQ ID NO: 261
  Synthetic polypeptide

SEQ ID NO: 1438 - DNA, 646 bp, Artificial Sequence; identical to SEQ ID NO: 262
  Synthetic polypeptide

SEQ ID NO: 1439 - DNA, 2505 bp, Artificial Sequence
  Synthetic polypeptide
atggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1440 - DNA, 2398 bp, Artificial Sequence
  Synthetic polypeptide
atatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1441 - DNA, 2367 bp, Artificial Sequence
  Synthetic polypeptide
atggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1442 - DNA, 1389 bp, Artificial Sequence
  Synthetic polypeptide
atgaaataccaggaggtcagatgtttaacctctttcaacatatctgtttcttttcctgcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1443 - DNA, 2637 bp, Artificial Sequence
  Synthetic polypeptide
atgttgttggaactggcaggccaagaggccctgaaaccagcaggtgccatctatatggagaaaagcggatgtagtccatttccagtgtgttgggctaaagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1444 - DNA, 1521 bp, Artificial Sequence
  Synthetic polypeptide
attgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1445 - DNA, 1509 bp, Artificial Sequence
  Synthetic polypeptide
atggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaaaagctatggaatagatgaagccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1446 - DNA, 435 bp, Artificial Sequence
  Synthetic polypeptide
atgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1447 - DNA, 1599 bp, Artificial Sequence
  Synthetic polypeptide
gcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcaggagtcagtcactgccaacataaagttaagaaagctaggcgctttctccctttggtcttctgttcccatgatcctccttctacggatgaaattagtggggacgaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaatct

SEQ ID NO: 1448 - DNA, 1736 bp, Artificial Sequence; identical to SEQ ID NO: 156
  Synthetic polypeptide

SEQ ID NO: 1449 - DNA, 1724 bp, Artificial Sequence; identical to SEQ ID NO: 157
  Synthetic polypeptide

SEQ ID NO: 1450 - DNA, 303 bp, Artificial Sequence; identical to SEQ ID NO: 148
  Synthetic polypeptide

SEQ ID NO: 1451 - DNA, 301 bp, Artificial Sequence; identical to SEQ ID NO: 147
  Synthetic polypeptide

SEQ ID NO: 1452 - DNA, 389 bp, Artificial Sequence
  Synthetic polypeptide
atgacactggcaactgacggcactgcggatatgtttggaataaggttcaaaagaagaggctgttctaagaaagactaccgagtaatcaatcacctcctcagagaaagtctgctcaggtggatacgtgtcatttgaattggtgaaaacccacagaatgcacaacatgaaaagtaagcagcaaatgatggagggacattaatatcaatgtatccaatattggcatatcaaatcttaacaaacaaacaggccacaataatacaaaacgttactaacagaggaaactggcaggaagtcaggaggagaagggcatgtatgagaactctgtactttctgccccatttttctgtaaacttcaaactgctctaaaaaataaagtctagtaatttttt

SEQ ID NO: 1453 - DNA, 1339 bp, Artificial Sequence
  Synthetic polypeptide
atgagtagaatgagacctgtgtgccaaccctggcctagtcctcatgcccccacaactgtgaagcgagagggctcaacagtttcgaattcaattcaaccaccacctcctgaataccaactaggttccaggacctggctagaagcagagacaccaggacagaaaagacagtgttctgctttcatggagttcacagaagagtcgaggagccgaagctggactgtactgctgccatctcggctcactgcagcctccctgcctgattctcctgcctcagcctgccaagtgcctgcgattgcaggcgcgcgccgccacgcctgactgcttttcgtatttttttggtggagacggggtttcgctgtgttggctgggctggtctccagctcctaaccgcgagtgatccgccagcctcggcctcctgaggtgccaggattgcagacggagtctggttcactcagtgctcaatggggcccaggctggagtgcagtggcgtgatctcggctcgctacaacctccacctcccagccgcctgccttggcctcccaaagtgccgagattgcagcctctgcccggctgccaccccgtctgggaagtgaggagcgtctctgcctggccgcccatcgtctgggacgtgaggagccccactgcctggctacccagtctggaaagtgaggagcgtctctgcccggccaccatcccatctaggaagtgaggagcgcctcttccctgcggccatcccgtctaggaagtgaggagcgcctcttccctgcggccatcccatctaggaagtgaggagcgtctctgcccggccgccatcccgtctaggaagtgaggagcgtctctgcccggccgccatcccgtctaggaagtgaggagcgtctctgcccggccgccatcccgtctaggaagtgaggagcgtctctgcccggcagccatcccgtctaggaagtgaggagcgtctctgcccggccgccatcccgtctaggaagtgaggagcacctcttcccggccgccatcccgtctaggaagtgaggagcgcctcttcccggccgccatcccatctaggaagtgaggagcgtctctgcccggcggcccatcatctgagatgtggggagcgcctctgccccgccgccccgtctgggatgtgaggagcgcctctacccagctgcgaccccgtctgggaggtgaggagcgtctctgcccagccgccccgtctgagaagtgaggagaccctctgcctggcaaccgccccatatgagaagtgaggagcccctccgcccggcagccaccccgtctgggaagtgaggagtgtctctgcctggcagccaccccatccgggagg

SEQ ID NO: 1454 - DNA, 857 bp, Artificial Sequence
  Synthetic polypeptide
atgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1455 - DNA, 749 bp, Artificial Sequence
  Synthetic polypeptide
tactgcagagacatccacaccaaatacagcagtgaatggggagctggagcactggaagataaaagcaggctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1456 - DNA, 773 bp, Artificial Sequence
  Synthetic polypeptide
atgagtatggaagattatgatttcctgttcaaaattgttttaattggcaacgctggtgtggggaagacgtgcctcgtccgaagattcactcagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1457 - DNA, 719 bp, Artificial Sequence
  Synthetic polypeptide
atgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggttctgctagcgttccgactcacaagactaccgtagaccacgcgtggcatcgtgttcacttagaaggacacaggacaggaaatacagcttgacagcagatcagcatccggcaaccctcttcagtggaagtaatcccagtagcagtccacgtaattttccaggacctcctacccagtccgcaacccccagacgattctagtatgagggaacaaggctcatgtcaaacagatggaggatctgccttggcctagcagcctcaataccccataggagactaaatctattataacaactccacaatcataacttccagggtctcttcaaatgaagtcaccacattcagggaagctcaaagttatggctttccattaggtatttataattcttagatagaattcccaggccagaagtcatttatcaatcaggggtcatttttaccataagcggtgttgccagataatacaattgacacacctttgtcaggtttcctggagaa

SEQ ID NO: 1458 - DNA, 2161 bp, Artificial Sequence; identical to SEQ ID NO: 288
  Synthetic polypeptide

SEQ ID NO: 1459 - DNA, 2140 bp, Artificial Sequence; identical to SEQ ID NO: 289
  Synthetic polypeptide

SEQ ID NO: 1460 - DNA, 529 bp, Artificial Sequence; identical to SEQ ID NO: 287
  Synthetic polypeptide

SEQ ID NO: 1461 - DNA, 2912 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1462 - DNA, 2825 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcagatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1463 - DNA, 2249 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtgtcagttgcagggctgggacctattatgatggagcacgagaacgctgcattttatgtccaaatggaaccttccaaaatgaggaaggacaaatgacttgtgaaccatgcccaagaccaggaaattctggggccctgaagaccccagaagcttggaatatgtctgaatgtggaggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaacttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1464 - DNA, 2741 bp, Artificial Sequence
  Synthetic polypeptide
atgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggtctgtgtcaacctggtgaatattctgcagatggctttgcaccttgccatctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1465 - DNA, 387 bp, Artificial Sequence
  Synthetic polypeptide
gggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1466 - DNA, 373 bp, Artificial Sequence
  Synthetic polypeptide
ggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaaggatagaaatcacatttagaaggtgcacatgaggctgctacagacgggccctctga

SEQ ID NO: 1467 - DNA, 15330 bp, Artificial Sequence
  Synthetic polypeptide
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggccgggtgtggtggctgacagctgtaatcccagcactttgggaggccaaggcgggtgaatcaccccaggtcaagagttcaagaccatccagcctgatgaacatggtgaaaccccgtctctactgaaaatacaaaaattagccagctgtggtggcgcatgcctgtaatcccagctacttgggaggccgaggcaggagaatcgcgtgaacccgggaggtggaggttgcagtgagccgggatcgcaccactgcactccagcctgggcaacaagagtgaaactccgtcttaaataaataaataaataaaaataaaataaaaaataaat

SEQ ID NO: 1468 - DNA, 15330 bp, Artificial Sequence
  Synthetic polypeptide
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtaggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggccgggtgtggtggctgacagctgtaatcccagcactttgggaggccaaggcgggtgaatcaccccaggtcaagagttcaagaccatccagcctgatgaacatggtgaaaccccgtctctactgaaaatacaaaaattagccagctgtggtggcgcatgcctgtaatcccagctacttgggaggccgaggcaggagaatcgcgtgaacccgggaggtggaggttgcagtgagccgggatcgcaccactgcactccagcctgggcaacaagagtgaaactccgtcttaaataaataaataaataaaaataaaataaaaaataaat

SEQ ID NO: 1469 - DNA, 15345 bp, Artificial Sequence
  Synthetic polypeptide
atgggtgacgcagaaggcgaagacgaggtccagttcctgcggacggacgatgaggtggtcctgcagtgcagcgctaccgtgctcaaggagcagctcaagctctgcctggccgccgagggcttcggcaaccgcctgtgcttcctggagcccactagcaacgcgcagaatgtgccccccgatctggccatctgttgcttcgtcctggagcagtccctgtctgtgcgagccctgcaggagatgctggctaacacggtggaggctggcgtggagtcatcccagggcgggggacacaggacgctcctgtatggccatgccatcctgctccggcatgcacacagccgcatgtatctgagctgcctcaccacctcccgctccatgactgacaagctggccttcgatgtgggactgcaggaggacgcaacaggagaggcttgctggtggaccatgcacccagcctccaagcagaggtctgaaggagaaaaggtccgcgttggggatgacatcatccttgtcagtgtctcctccgagcgctacctgcacctgtcgaccgccagtggggagctccaggttgacgcttccttcatgcagacactatggaacatgaaccccatctgctcccgctgcgaagagggcttcgtgacgggaggtcacgtcctccgcctctttcatggacatatggatgagtgtctgaccatttcccctgctgacagtgatgaccagcgcagacttgtctactatgaggggggagctgtgtgcactcatgcccgctccctctggaggctggagccactgagaatcagctggagtgggagccacctgcgctggggccagccactccgagtccggcatgtcactaccgggcagtacctagcgctcaccgaggaccagggcctggtggtggttgacgccagcaaggctcacaccaaggctacctccttctgcttccgcatctccaaggagaagctggatgtggcccccaagcgggatgtggagggcatgggcccccctgagatcaagtacggggagtcactgtgcttcgtgcagcatgtggcctcaggactgtggctcacctatgctgctccagaccccaaggccctgcggctcggcgtgctcaagaagaaggccatgctgcaccaggagggccacatggacgacgcactgtcgctgacccgctgccagcaggaggagtcccaggccgcccgcatgatccacagcaccaatggcctatacaaccagttcatcaagagcctggacagcttcagcgggaagccacggggctcggggccacccgctggcacggcgctgcccatcgagggcgttatcctgagcctgcaggacctcatcatctacttcgagcctccctccgaggacttgcagcacgaggagaagcagagcaagctgcgaagcctgcgcaaccgccagagcctcttccaggaggaggggatgctctccatggtcctgaattgcatagaccgcctaaatgtctacaccactgctgcccactttgctgagtttgcaggggaggaggcagccgagtcctggaaagagattgtgaatcttctctatgaactcctagcttctctaatccgtggcaatcgtagcaactgtgccctcttctccacaaacttggactggctggtcagcaagctggatcggctggaggcctcgtctggcatcctggaggtcctgtactgtgtcctcattgagagtccagaggttctgaacatcatccaggagaatcacatcaagtccatcatctccctcctggacaagcatgggaggaaccacaaggtcctggacgtgctatgctccctgtgtgtgtgtaatggtgtggctgtacgctccaaccaagatcttattactgagaacttgctgcctggccgtgagcttctgctgcagacaaacctcatcaactatgtcaccagcatccgccccaacatctttgtgggccgagcggaaggcaccacgcagtacagcaaatggtactttgaggtgatggtggacgaggtgactccatttctgacagctcaggccacccacttgcgggtgggctgggccctcaccgagggctacaccccctaccctggggccggcgagggctggggcggcaacggggtcggcgatgacctctattcctacggctttgatggactgcatctctggacaggacacgtggcacgcccagtgacttccccagggcagcacctcctggcccctgaagacgtgatcagctgctgcctggacctcagcgtgccgtccatctccttccgcatcaacggctgccccgtgcagggtgtctttgagtccttcaacctggacgggctcttcttccctgttgtcagcttctcggctggtgtcaaggtgcggttcctccttggtggccgccatggtgaattcaagttcctgcccccacctggctatgctccatgccatgaggctgtgctccctcgagagcgactccatcttgaacccatcaaggagtatcgacgggaggggccccgggggcctcacctggtgggccccagtcgctgcctctcacacaccgacttcgtgccctgccctgtggacactgtccagattgtcctgccgccccatctggagcgcattcgggagaagctggcggagaacatccacgagctctgggcgctaacccgcatcgagcagggctggacctacggcccggttcgggatgacaacaagaggctgcacccgtgtcttgtggacttccacagccttccagagcctgagaggaactacaacctgcagatgtctggggagacgctcaagactctgctggctctgggctgccacgtgggcatggcggatgagaaggcggaggacaacctgaagaagacaaaactccccaagacgtatatgatgagcaatgggtacaagccggctccgctggacctgagccacgtgcggctgacgccggcgcagacgacactggtggaccgtctggcagaaaatgggcacaacgtgtgggcccgagaccgcgtgggccagggctggagctacagcgcagtgcaggacatcccagcgcgccgaaaccctcggctggtgccctaccgcctgctggatgaagccaccaagcgcagcaaccgggacagcctctgccaggccgtgcgcaccctcctgggctacggctacaacatcgagcctcctgaccaggagcccagtcaggtggagaaccagtctcgttgtgaccgggtgcgcatcttccgggcagagaaatcctatacagtgcagagcggccgctggtacttcgagtttgaagcagtcaccacaggcgagatgcgcgtgggctgggcgaggcccgagctgaggcctgatgtagagctgggagctgacgagctggcctatgtcttcaatgggcaccgcggccagcgctggcacttgggcagtgaaccatttgggcgcccctggcagccgggcgatgtcgttggctgtatgatcgacctcacagagaacaccattatcttcaccctcaatggcgaggtcctcatgtctgactcaggctccgaaacagccttccgggagattgagattggggacggcttcctgcccgtctgcagcttgggacctggccaggtgggtcatctgaacctgggccaggacgtgagctctctgaggttctttgccatctgtggcctccaggaaggcttcgagccatttgccatcaacatgcagcgcccagtcaccacctggttcagcaaaggcctgccccagtttgagccagtgccccttgaacaccctcactatgaggtatcccgagtggacggcactgtggacacgcccccctgcctgcgcctgacccaccgcacctggggctcccagaacagcctggtggagatgcttttcctgcggctgagcctcccagtccagttccaccagcacttccgctgcactgcaggggccaccccgctggcacctcctggcctgcagccccccgccgaggacgaggcccgggcggcggaacccgaccctgactacgaaaacctgcgccgctcagctgggggctggagcgaggcagagaacggcaaagaagggactgcgaaggagggcgcccccgggggcaccccgcaggcggggggagaggcgcagcccgccagggcggagaatgagaaggatgccaccaccgagaagaacaagaagagaggcttcttattcaaggccaagaaggtcgccatgatgacccagccaccggccacccccacgctgccccgactccctcacgacgtggtgcctgcagacaaccgcgatgaccccgagatcatcctcaacaccaccacgtactattactccgtgagggtctttgctggacaggagcccagctgcgtgtgggcgggctgggtcacccctgactaccatcagcacgacatgagcttcgacctcagcaaggtccgggtcgtgacggtgaccatgggggatgaacaaggcaacgtccacagcagcctcaagtgtagcaactgctacatggtgtggggcggagactttgtgagtcccgggcagcagggccggatcagccacacggaccttgtcattgggtgcctggtggacttggccactggcttaatgacctttacagccaatggcaaagagagcaacacctttttccaggtggaacccaacactaagctatttcctgccgtcttcgtcctgcccacccaccagaacgtcatccagtttgagctggggaagcagaagaacatcatgccgttgtcagccgccatgttccaaagcgagcgcaagaacccggccccgcagtgcccaccgcggctggagatgcagatgctgatgccagtgtcctggagccgcatgcccaaccacttcctgcaggtggagacgaggcgtgccggcgagcggctgggctgggccgtgcagtgccaggagccgctgaccatgatggcgctgcacatccccgaggagaaccggtgcatggacatcctggagctgtcggagcgcctggacctgcagcgcttccactcgcacaccctgcgcctctaccgcgctgtgtgcgccctgggcaacaatcgcgtggcgcacgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgctggggcagcagaggccccggcccgcctcagccctgccatcccgctggaggccctgcgggacaaggcactgaggatgctgggggaggcggtgcgcgacggtgggcagcacgctcgcgaccccgtcgggggctccgtggagttccagtttgtgcctgtgctcaagctcgtgtccaccctgctggtgatgggcatctttggcgatgaggatgtgaaacagatcttgaagatgattgagcctgaggtcttcactgaggaagaagaggaggaggacgaggaggaagagggtgaagaggaagatgaggaggagaaggaggaggatgaggaggaaacagcacaggaaaaggaagatgaggaaaaagaggaagaggaggcagcagaaggggagaaagaagaaggcttggaggaagggctgctccagatgaagttgccagagtctgtgaagttacagatgtgccacctgctggagtatttctgtgaccaagagctgcagcaccgtgtggagtccctggcagcctttgcggagcgctatgtggacaagctccaggccaaccagcggagccgctatggcctcctcataaaagccttcagcatgaccgcagcagagactgcaagacgtacccgcgagttccgctccccaccccaggaacagatcaatatgctattgcaattcaaagatggtacagatgaggaagactgtcctctccctgaagagattcgacaggatttgcttgactttcatcaagacctgctggcacactgtggaattcagctagatggagaggaggaggaaccagaggaagagaccaccctgggcagccgcctcatgagcctgttggagaaagtgcggctggtgaagaagaaggaagagaaacctgaggaggagcggtcagcagaggagagcaaaccccggtccctgcaggagctggtgtcccacatggtggtgcgctgggcccaagaggacttcgtgcagagccccgagctggtgcgggccatgttcagcctcctgcaccggcagtacgacgggctgggtgagctgctgcgtgccctgccgcgggcgtacaccatctcaccgtcctccgtggaagacaccatgagcctgctcgagtgcctcggccagatccgctcgctgctcatcgtgcagatgggcccccaggaggagaacctcatgatccagagcatcgggaacatcatgaacaacaaagtcttctaccaacacccgaacctgatgagggcgctgggcatgcacgagacggtcatggaggtcatggtcaacgtcctcgggggcggcgagtccaaggagatccgcttccccaagatggtgacaagctgctgccgcttcctctgctatttctgccgaatcagccggcagaaccagcgctccatgtttgaccacctgagctacctgctggagaacagtggcatcggcctgggcatgcagggctccacgcccctggacgtggctgctgcctccgtcattgacaacaatgagctggccttggcattgcaggagcaggacctggaaaaggttgtgtcctacctggcaggctgtggcctccagagctgccccatgcttgtggccaaagggtacccagacattggctggaacccctgtggtggagagcgctacctggacttcctgcgctttgctgtcttcgtcaacggcgagagcgtggaggagaacgccaatgtggtggtgcggctgctcatccggaagcctgagtgcttcggacccgccctgcggggtgagggtggctcagggctgctggctgccatcgaagaggccatccgcatctccgaggaccctgcgagggatggcccaggcatccgcagggaccggcggcgcgagcactttggtgaggaaccgcctgaagaaaaccgggtgcacctgggacacgccatcatgtccttctatgccgccttgatcgacctgctcggacgctgtgcaccagagatgcatctaatccaagccggcaagggtgaggccctgcggatccgcgccatcctccgctcccttgtgcccttggaggaccttgtgggcatcatcagcctcccactgcagattcccaccctgggcaaagatggggctctggtgcagccaaagatgtcagcatccttcgtgccggaccacaaggcgtccatggtgctcttcctggaccgtgtgtatggcatcgagaaccaggacttcttgctgcacgtgctggacgtggggttcctgcccgacatgagggcagccgcctcgctggacacggccactttcagcaccaccgagatggcgctggcgctgaaccgctacctgtgcctggccgtgctgccgctcatcaccaagtgtgcgccgctctttgcgggcacagaacaccgcgccatcatggtggactctatgctgcataccgtgtaccgcctgtctcggggtcgttcgctcaccaaggcgcagcgtgacgtcatcgaggactgcctcatgtcgctctgcaggtacatccgcccgtcgatgctgcagcacctgttgcgccgcctggtgttcgacgtgcccatcctcaacgagttcgccaagatgccactcaagctcctcaccaaccactatgagcgctgttggaagtactactgcctacccacgggctgggccaacttcggggtcacctcagaggaggagctgcacctcacacggaaactcttctggggcatctttgactctctggcccataagaaatacgacccggagctgtaccgcatggccatgccttgtctgtgcgccattgccggggctctgccccccgactatgtggatgcctcatactcatctaaggcagagaaaaaggccacagtggatgctgaaggcaactttgatccccggcctgtggagaccctcaatgtgatcatcccggagaagctggactccttcattaacaagtttgcggagtacacacacgagaagtgggccttcgacaagatccagaacaactggtcctatggagagaacatagacgaggagctgaagacccaccccatgctgaggccctacaagaccttttcagagaaggacaaagagatttaccgctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagtgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttggcttcctgcagcagctgctgcgctggatggacatttctcaggagttcattgcccacctggaggctgtggtcagcagtgggcgagtggaaaagtccccacatgaacaggagattaaattctttgccaagatcctgctccctttgatcaaccagtacttcaccaaccactgcctctatttcttgtccactccggctaaagtgctgggcagcggtggccacgcctctaacaaggagaaggaaatgatcaccagcctcttctgcaaacttgctgctctcgtccgccaccgagtctctctctttgggacagacgccccagctgtggtcaactgtcttcacatcctggcccgctccctggatgccaggacagtgatgaagtcaggccctgagatcgtgaaggctggcctccgctccttcttcgagagtgcctcggaggacatcgagaagatggtggagaacctgcggctgggcaaggtgtcgcaggcgcgcacccaggtgaaaggcgtgggccagaacctcacctacaccactgtggcactgctgccggtcctcaccaccctcttccagcacatcgcccagcaccagttcggagatgacgtcatcctggacgacgtccaggtctcttgctaccgaacgctgtgcagtatctactccctgggaaccaccaagaacacttatgtggaaaagcttcggccagccctcggggagtgcctggcccgtctggcagcagccatgccggtggcgttcctggagccgcagctgaacgagtacaacgcctgctccgtgtacaccaccaagtctccgcgggagcgggccatcctggggctccccaacagtgtggaggagatgtgtcccgacatcccggtgctggagcggctcatggcagacattggggggctggccgagtcaggtgcccgctacacagagatgccgcatgtcatcgagatcacgctgcccatgctatgcagctacctgccccgatggtgggagcgcgggcccgaggcacccccttccgccctgcccgccggcgcccccccaccctgcacagctgtcacctctgaccacctcaactccctgctggggaatatcctgagaatcatcgtcaacaacctgggcattgacgaggcctcctggatgaagcggctggctgtgttcgcacagcccattgtgagccgtgcacggccggagctcctgcagtcccacttcatcccaactatcgggcggctgcgcaagagggcagggaaggtggtgtccgaggaggagcagctgcgcctggaggccaaggcggaggcccaggagggcgagctgctggtgcgggacgagttctctgtgctctgccgggacctctacgccctgtatccgctgctcatccgctacgtggacaacaacagggcgcagtggctgacggagccgaatcccagcgcggaggagctgttcaggatggtgggcgagatcttcatctactggtccaagtcccacaacttcaagcgcgaggagcagaactttgtggtccagaatgagatcaacaacatgtccttcctgactgctgacaacaaaagcaaaatggctaaggcgggagatatacagtccggtggctcggaccaggaacgcaccaagaagaagcgccggggggaccggtactctgtgcagacgtcactgatcgtggccacactgaagaagatgctgcccatcggcctgaatatgtgtgcgcccaccgaccaagacctcatcacgctggccaagacccgttacgccctgaaagacacagatgaggaggtccgggaatttctgcacaacaaccttcaccttcagggaaaggtcgaaggctccccgtctctgcgctggcagatggctctgtaccggggcgtcccgggtcgcgaggaggacgccgatgaccccgagaaaatcgtgcgcagagtccaggaagtgtcagccgtgctctactacctggaccagaccgagcacccttacaagtctaagaaggccgtgtggcacaagcttttgtccaaacagcgccggcgggcagtcgtggcctgtttccgtatgacgcccctgtacaacctgcccacgcaccgggcatgtaacatgttcctggagagctacaaggctgcatggatcctgactgaagaccacagttttgaggaccgcatgatagatgacctttcaaaagctggggagcaggaggaggaggaggaagaggtggaagagaagaagccagaccccctgcaccagttggtcctgcacttcagccgcactgccctgacggaaaagagcaaactggatgaggattacctgtacatggcctatgctgatatcatggcaaagagctgccacctggaggagggaggggagaacggtgaagctgaagaggaggttgaggtctcctttgaggagaaacagatggagaagcagaggctcttgtaccagcaagcacggctgcacacccggggggcggccgagatggtgctgcagatgatcagtgcctgcaaaggagagacaggtgccatggtgtcctccaccctgaagctgggcatctccatcctcaatggaggcaatgctgaggtccagcagaaaatgctggattatcttaaggacaagaaggaagttggcttcttccagagtatccaggcactgatgcaaacatgcagcgtcctggatctcaatgcctttgagagacagaacaaggccgaggggctgggcatggtgaatgaggatggcactgtcatcaatcgccagaacggagagaaggtcatggcggatgatgaattcacacaagacctgttccgattcctacaattgctctgtgaggggcacaataatgatttccagaactacctacggacacagacagggaacacgaccactattaacatcatcatttgcactgtggactacctcctgcggctgcaggaatccatcagcgacttctactggtactactcgggcaaggatgtcattgaagagcagggcaagaggaacttctccaaagccatgtcggtggctaagcaggtgttcaacagcctcactgagtacatccagggtccctgcaccgggaaccagcagagcctggcgcacagtcgcctatgggacgcagtggtgggattcctgcacgtgttcgcccacatgatgatgaagctcgctcaggactcaagccagatcgagctgctgaaggagctgctggatctgcagaaggacatggtggtgatgttgctgtcgctactagaagggaacgtggtgaacggcatgatcgcccggcagatggtggacatgctcgtggaatcctcatccaatgtggagatgatcctcaagttcttcgacatgttcctgaaactcaaggacattgtgggctctgaagccttccaggactacgtaacggatccccgtggcctcatctccaagaaggacttccagaaggccatggacagccagaagcagttcagcggtccagaaatccagttcctgctttcgtgctccgaagcggatgagaacgaaatgatcaactgcgaagagttcgccaaccgcttccaggagccagcacgcgacatcggcttcaacgtggcggtgctgctgaccaacctgtcggagcatgtgccgcatgaccctcgcctgcacaacttcctggagctggccgagagcatccttgagtacttccgcccctacctgggccgcatcgagatcatgggcgcgtcacgccgcatcgagcgcatctacttcgagatctcagagaccaaccgcgcccagtgggagatgccccaggtgaaggagtccaagcgccagttcatcttcgacgtggtgaacgagggcggcgaggctgagaagatggagctcttcgtgagtttctgcgaggacaccatcttcgagatgcagatcgccgcgcagatctcggagcccgagggcgagccggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcctgctctggggctcgctgttcggcggcggcctggtggagggcgccaagaaggtgacggtgaccgagctcctggcaggcatgcccgaccccaccagcgacgaggtgcacggcgagcagccggccgggccgggcggagacgcagacggcgagggtgccagcgagggcgctggagacgccgcggagggcgctggagacgaggaggaggcggtgcacgaggccgggccgggcggtgccgacggggcggtggccgtgaccgatgggggccccttccggcccgaaggggctggcggtctcggggacatgggggacacgacgcctgcggaaccgcccacacccgagggctctcccatcctcaagaggaaattgggggtggatggagtggaggaggagctcccgccagagccagagcccgagccggaaccagagctggagccggagaaagccgatgccgagaatggggagaaggaagaagttcccgagcccacaccagagccccccaagaagcaagcacctccctcaccccctccaaagaaggaggaagctggaggcgaattctggggagaactggaggtgcagagggtgaagttcctgaactacctgtcccggaacttttacaccctgcggttccttgccctcttcttggcatttgccatcaacttcatcttgctgttttataaggtctcagactctccaccaggggaggacgacatggaaggctcagctgctggggatgtgtcaggtgcaggctctggtggcagctctggctggggcttgggggccggagaggaggcagagggcgatgaggatgagaacatggtgtactacttcctggaggaaagcacaggctacatggaacccgccctgcggtgtctgagcctcctgcatacactggtggcctttctctgcatcattggctataattgtctcaaggtgcccctggtaatctttaagcgggagaaggagctggcccggaagctggagtttgatggcctgtacatcacggagcagcctgaggacgatgacgtgaaggggcagtgggaccgactggtgctcaacacgccgtctttccctagcaactactgggacaagtttgtcaagcgcaaggtcctggacaaacatggggacatctacgggcgggagcggattgctgagctactgggcatggacctggccacactagagatcacagcccacaatgagcgcaagcccaacccgccgccagggctgctgacctggctcatgtccatcgatgtcaagtaccagatctggaagttcggggtcatcttcacagacaactccttcctgtacctgggctggtatatggtgatgtccctcttgggacactacaacaacttcttctttgctgcccatctcctggacatcgccatgggggtcaagacgctgcgcaccatcctgtcctctgtcacccacaatgggaaacagctggtgatgaccgtgggccttctggcggtggtcgtctacctgtacaccgtggtggccttcaacttcttccgcaagttctacaacaagagcgaggatgaggatgaacctgacatgaagtgtgatgacatgatgacgtgttacctgtttcacatgtacgtgggtgtccgggctggcggaggcattggggacgagatcgaggaccccgcgggtgacgaatacgagctctacagggtggtcttcgacatcaccttcttcttcttcgtcatcgtcatcctgttggccatcatccagggtctgatcatcgacgcttttggtgagctccgagaccaacaagagcaagtgaaggaggatatggagaccaagtgcttcatctgtggaatcggcagtgactactttgatacgacaccgcatggcttcgagactcacacgctggaggagcacaacctggccaattacatgtttttcctgatgtatttgataaacaaggatgagacagaacacacgggtcaggccgggtgtggtggctgacagctgtaatcccagcactttgggaggccaaggcgggtgaatcaccccaggtcaagagttcaagaccatccagcctgatgaacatggtgaaaccccgtctctactgaaaatacaaaaattagccagctgtggtggcgcatgcctgtaatcccagctacttgggaggccgaggcaggagaatcgcgtgaacccgggaggtggaggttgcagtgagccgggatcgcaccactgcactccagcctgggcaacaagagtgaaactccgtcttaaataaataaataaataaaaataaaataaaaaataaat

SEQ ID NO: 1470 - DNA, 193 bp, Artificial Sequence; identical to SEQ ID NO: 975
  Synthetic polypeptide

SEQ ID NO: 1471 - DNA, 1221 bp, Artificial Sequence; identical to SEQ ID NO: 122
  Synthetic polypeptide

SEQ ID NO: 1472 - DNA, 303 bp, Artificial Sequence; identical to SEQ ID NO: 148
  Synthetic polypeptide

SEQ ID NO: 1473 - DNA, 301 bp, Artificial Sequence; identical to SEQ ID NO: 147
  Synthetic polypeptide

SEQ ID NO: 1474 - DNA, 3992 bp, Artificial Sequence; identical to SEQ ID NO: 120
  Synthetic polypeptide

SEQ ID NO: 1475 - DNA, 3845 bp, Artificial Sequence; identical to SEQ ID NO: 121
  Synthetic polypeptide

SEQ ID NO: 1476 - DNA, 371 bp, Artificial Sequence; identical to SEQ ID NO: 1008
  Synthetic polypeptide

SEQ ID NO: 1477 - DNA, 272 bp, Artificial Sequence; identical to SEQ ID NO: 1009
  Synthetic polypeptide

SEQ ID NO: 1478 - DNA, 999 bp, Artificial Sequence; identical to SEQ ID NO: 983
  Synthetic polypeptide

SEQ ID NO: 1479 - DNA, 317 bp, Artificial Sequence; identical to SEQ ID NO: 995
  Synthetic polypeptide

SEQ ID NO: 1480 - DNA, 639 bp, Artificial Sequence; identical to SEQ ID NO: 1176
  Synthetic polypeptide

SEQ ID NO: 1481 - DNA, 2409 bp, Artificial Sequence
  Synthetic polypeptide
atgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagatacaaaaattagccgggcatggtggcacgcacctgtagtcccagctacttgtgaggctgaggcaggagaatcgcttgaatccgggaggcggaggttgcagtgagccgagatcatgccacttcactccagcctgagtgacagagtgagtctccgtctaaaaaaaaaaaacagaaactagaaaagaa

SEQ ID NO: 1482 - DNA, 603 bp, Artificial Sequence; identical to SEQ ID NO: 1012
  Synthetic polypeptide

SEQ ID NO: 1483 - DNA, 1834 bp, Artificial Sequence; identical to SEQ ID NO: 133
  Synthetic polypeptide

SEQ ID NO: 1484 - DNA, 1765 bp, Artificial Sequence; identical to SEQ ID NO: 135
  Synthetic polypeptide

SEQ ID NO: 1485 - DNA, 610 bp, Artificial Sequence; identical to SEQ ID NO: 163
  Synthetic polypeptide

SEQ ID NO: 1486 - DNA, 703 bp, Artificial Sequence
  Synthetic polypeptide
atgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1487 - DNA, 1015 bp, Artificial Sequence
  Synthetic polypeptide
atgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattgagtgccacccatatcttactcagaagaatctgatcagtttttgccaatccagagatgtgtccgtgactgcttaccgtcctcttggtggctcgtgtgagggggttgacctgatagacaaccctgtgatcaagaggattgcaaaggagcacggcaagtctcctgctcagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1488 - DNA, 844 bp, Artificial Sequence
  Synthetic polypeptide
atgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggaggccatggaggacctggtgatcaccgggctggtgaagaacatcggggtgtcaaacttcaaccatgaacagcttgagaggcttttgaataagcctgggttgaggttcaagccactaaccaaccagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1489 - DNA, 721 bp, Artificial Sequence
  Synthetic polypeptide
atgggagatatcccagccgtgggcctcagctcctggaaggcttctccagggaaagtgaccgaggcagtgaaagaggccattgacgcagggtaccggcacttcgactgtgcttacttttaccacaatgagagggaggttggagcagggatccgttgcaagatcaaggaaggcgctgtaagacgggaggatctgttcattgccactaagctgtggtgcacctgccataagaagtccttggtggaaacagcatgcagaaagagtctcaaggccttgaagctgaactatttggacctctacctcatacactggcccatgggtttcaagcctcctcatccagaatggatcatgagctgcagtgaactttccttctgcctctcacatcctcgagtgcaggacttgcctctggacgagagcaacatggttattcccagtgacacggacttcctggacacgtgggagattttgatccgatttcaaatccagaggaatgtgatagtgatccccggatctatcaccccaagtcacattaaagagaatatccaggctctctttttgcctgctgccatccatgtaagacgcgacttgtttctccttgccttctgtcatgattgtgaggcttccccagacacttggaactgtaagtccattaaacctctcttcttttgtaaattacccagtcttgagtatgtctttatcagcagtgtgaaaatggactaataca

SEQ ID NO: 1490 - DNA, 1398 bp, Artificial Sequence; identical to SEQ ID NO: 948
  Synthetic polypeptide

SEQ ID NO: 1491 - DNA, 1302 bp, Artificial Sequence; identical to SEQ ID NO: 949
  Synthetic polypeptide

SEQ ID NO: 1492 - DNA, 487 bp, Artificial Sequence; identical to SEQ ID NO: 918
  Synthetic polypeptide

SEQ ID NO: 1493 - DNA, 170 bp, Artificial Sequence
  Synthetic polypeptide
atggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaaggtgtaattattatt

SEQ ID NO: 1494 - DNA, 8343 bp, Artificial Sequence
  Synthetic polypeptide
atgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatg

SEQ ID NO: 1495 - DNA, 434 bp, Artificial Sequence; identical to SEQ ID NO: 992
  Synthetic polypeptide

SEQ ID NO: 1496 - DNA, 822 bp, Artificial Sequence; identical to SEQ ID NO: 119
  Synthetic polypeptide

SEQ ID NO: 1497 - DNA, 1731 bp, Artificial Sequence; identical to SEQ ID NO: 989
  Synthetic polypeptide

SEQ ID NO: 1498 - DNA, 2262 bp, Artificial Sequence; identical to SEQ ID NO: 990
  Synthetic polypeptide

SEQ ID NO: 1499 - DNA, 2253 bp, Artificial Sequence; identical to SEQ ID NO: 991
  Synthetic polypeptide

SEQ ID NO: 1500 - DNA, 157 bp, Artificial Sequence
  Synthetic polypeptide
atgtaccaggtgagcggccagcgcccctctggctgcgacgcgccctatggagcccccagcgcagccccgggcccaggtctgttcctgaacctctgacacgaactccctgccttgccttggacaagctccttcccttctctggcctgagcctccacat

SEQ ID NO: 1501 - DNA, 1146 bp, Artificial Sequence; identical to SEQ ID NO: 988
  Synthetic polypeptide

SEQ ID NO: 1502 - DNA, 2154 bp, Artificial Sequence
  Synthetic polypeptide
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaatggggataatggaatctgcctcctgggactgtcacgagaattagatgag

SEQ ID NO: 1503 - DNA, 2025 bp, Artificial Sequence
  Synthetic polypeptide
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaatggggataatggaatctgcctcctgggactgtcacgagaattagatgag

SEQ ID NO: 1504 - DNA, 1394 bp, Artificial Sequence; identical to SEQ ID NO: 1118
  Synthetic polypeptide

SEQ ID NO: 1505 - DNA, 1625 bp, Artificial Sequence; identical to SEQ ID NO: 1119
  Synthetic polypeptide

SEQ ID NO: 1506 - DNA, 1505 bp, Artificial Sequence; identical to SEQ ID NO: 1120
  Synthetic polypeptide

SEQ ID NO: 1507 - DNA, 1562 bp, Artificial Sequence; identical to SEQ ID NO: 1121
  Synthetic polypeptide

SEQ ID NO: 1508 - DNA, 1601 bp, Artificial Sequence; identical to SEQ ID NO: 1122
  Synthetic polypeptide

SEQ ID NO: 1509 - DNA, 1631 bp, Artificial Sequence; identical to SEQ ID NO: 1123
  Synthetic polypeptide

SEQ ID NO: 1510 - DNA, 763 bp, Artificial Sequence; identical to SEQ ID NO: 261
  Synthetic polypeptide

SEQ ID NO: 1511 - DNA, 646 bp, Artificial Sequence; identical to SEQ ID NO: 262
  Synthetic polypeptide

SEQ ID NO: 1512 - DNA, 750 bp, Artificial Sequence; identical to SEQ ID NO: 1060
  Synthetic polypeptide

SEQ ID NO: 1513 - DNA, 296 bp, Artificial Sequence; identical to SEQ ID NO: 1061
  Synthetic polypeptide

SEQ ID NO: 1514 - DNA, 721 bp, Artificial Sequence; identical to SEQ ID NO: 414
  Synthetic polypeptide

SEQ ID NO: 1515 - DNA, 1052 bp, Artificial Sequence; identical to SEQ ID NO: 247
  Synthetic polypeptide

SEQ ID NO: 1516 - DNA, 327 bp, Artificial Sequence; identical to SEQ ID NO: 246
  Synthetic polypeptide

SEQ ID NO: 1517 - DNA, 890 bp, Artificial Sequence; identical to SEQ ID NO: 319
  Synthetic polypeptide

SEQ ID NO: 1518 - DNA, 947 bp, Artificial Sequence; identical to SEQ ID NO: 320
  Synthetic polypeptide

SEQ ID NO: 1519 - DNA, 177 bp, Artificial Sequence
  Synthetic polypeptide
atgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacaggacctggcacaggagggtgcgcatta

SEQ ID NO: 1520 - DNA, 1839 bp, Artificial Sequence; identical to SEQ ID NO: 1059
  Synthetic polypeptide

SEQ ID NO: 1521 - DNA, 500 bp, Artificial Sequence; identical to SEQ ID NO: 204
  Synthetic polypeptide

SEQ ID NO: 1522 - DNA, 656 bp, Artificial Sequence; identical to SEQ ID NO: 205
  Synthetic polypeptide

SEQ ID NO: 1523 - DNA, 524 bp, Artificial Sequence; identical to SEQ ID NO: 207
  Synthetic polypeptide

SEQ ID NO: 1524 - DNA, 2557 bp, Artificial Sequence
  Synthetic polypeptide
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagataccacctctgttgatctgggaactaagaccatgttgcttgtccttagtcacatatgacttaatttgcacccattgtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgcttataaagagcagcctaaagtcccattctcttgcctgtaagcaacaaaattacaaaaatgttgaatttctaaaatgcgaaagttaagcattccagagaccagctcatggaagaaggttttatgtttttgggtgttgtaac

SEQ ID NO: 1525 - DNA, 2428 bp, Artificial Sequence
  Synthetic polypeptide
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagataccacctctgttgatctgggaactaagaccatgttgcttgtccttagtcacatatgacttaatttgcacccattgtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgcttataaagagcagcctaaagtcccattctcttgcctgtaagcaacaaaattacaaaaatgttgaatttctaaaatgcgaaagttaagcattccagagaccagctcatggaagaaggttttatgtttttgggtgttgtaac

SEQ ID NO: 1526 - DNA, 965 bp, Artificial Sequence; identical to SEQ ID NO: 1035
  Synthetic polypeptide

SEQ ID NO: 1527 - DNA, 725 bp, Artificial Sequence; identical to SEQ ID NO: 1036
  Synthetic polypeptide

SEQ ID NO: 1528 - DNA, 2181 bp, Artificial Sequence
  Synthetic polypeptide
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaaataagaatgatcaaagcgcctgcctcgtacagtggtcatgaggatcgaacgaagagagctatgtggagagcctgg

SEQ ID NO: 1529 - DNA, 2052 bp, Artificial Sequence
  Synthetic polypeptide
atgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaaataagaatgatcaaagcgcctgcctcgtacagtggtcatgaggatcgaacgaagagagctatgtggagagcctgg

SEQ ID NO: 1530 - DNA, 609 bp, Artificial Sequence; identical to SEQ ID NO: 249
  Synthetic polypeptide

SEQ ID NO: 1531 - DNA, 738 bp, Artificial Sequence; identical to SEQ ID NO: 250
  Synthetic polypeptide

SEQ ID NO: 1532 - DNA, 537 bp, Artificial Sequence; identical to SEQ ID NO: 251
  Synthetic polypeptide

SEQ ID NO: 1533 - DNA, 684 bp, Artificial Sequence; identical to SEQ ID NO: 253
  Synthetic polypeptide

SEQ ID NO: 1534 - DNA, 285 bp, Artificial Sequence; identical to SEQ ID NO: 255
  Synthetic polypeptide

SEQ ID NO: 1535 - DNA, 552 bp, Artificial Sequence; identical to SEQ ID NO: 254
  Synthetic polypeptide

SEQ ID NO: 1536 - DNA, 1493 bp, Artificial Sequence
  Synthetic polypeptide
atggagcagcgccgcgtcaccgacttcttcgcgcgccgccgccccgggcccccccgcatcgcgccgcccaagctggcctgccgcacccccagccccgccaggcccgcactccgcgccccggcctccgctaccagtggcagccgcaagcgcgcccgcccgcccgccgcccccggacgcgaccaggccaggccaccggcccgcaggagactgcggctgtcggtggacgaggtttccagccccagtacccccgaggccccagacatcccagcctgcccttctccgggccagaagataaagaaatccaccccggcagcaggtcagccgccccacctgacatccgcgcaggaccaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagtgcaatgttggccagatcaaaaccgtgtacccggcctcctaccgcttccgccaggagcgcagtgtccccaccttcaaggatggcaccaggaggtcagattaccagctcaccatcgagccactgctggagcaggaggctgacggagcagccccccagctcacggcctcgcgcctcctgcagcgacggcagatcttcagccagaagctggtggagcatgtcaaggagcaccacaaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctgggccttcatgacaggg

SEQ ID NO: 1537 - DNA, 980 bp, Artificial Sequence; identical to SEQ ID NO: 139
  Synthetic polypeptide

SEQ ID NO: 1538 - DNA, 1256 bp, Artificial Sequence; identical to SEQ ID NO: 140
  Synthetic polypeptide

SEQ ID NO: 1539 - DNA, 1277 bp, Artificial Sequence; identical to SEQ ID NO: 142
  Synthetic polypeptide

SEQ ID NO: 1540 - DNA, 1094 bp, Artificial Sequence; identical to SEQ ID NO: 153
  Synthetic polypeptide

SEQ ID NO: 1541 - DNA, 2572 bp, Artificial Sequence
  Synthetic polypeptide
atggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1542 - DNA, 2407 bp, Artificial Sequence
  Synthetic polypeptide
atgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1543 - DNA, 651 bp, Artificial Sequence
  Synthetic polypeptide
atggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1544 - DNA, 391 bp, Artificial Sequence
  Synthetic polypeptide
gtggttctccgcaatgacgtggcaccaaccatcatcccgacacccatgtaccgtcctcggccagccaacccagatgaaatcggcaactttataattgagagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctatttgttctgttcttgggagaaccctgactaataca

SEQ ID NO: 1545 - DNA, 5505 bp, Artificial Sequence
  Synthetic polypeptide
atggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggcaggttcacaggctgcagcctcagccaggagcacgtagagtcactctgctggttgctgagcaagtgtaaagacctcagccaggtggatctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctcccaatctgcaga

SEQ ID NO: 1546 - DNA, 5418 bp, Artificial Sequence
  Synthetic polypeptide
atggaccccgttggcctccagctcggcaacaagaacctgtggagctgtcttgtgaggctgctcaccaaagacccagaatggctgaacgccaagatgaagttcttcctccccaacacggacctggattccaggaacgagaccttggaccctgaacagagagtcatcctgcaactcaacaagctgcatgtccagggttcggacacctggcagtctttcattcattgtgtgtgcatgcagctggaggtgcctctggacctggaggtgctgctgctgagtacttttggctatgatgatgggttcaccagccagctgggagctgaggggaaaagccaacctgaatctcagctccaccatggcctgaagcgcccacatcagagctgtgggtcctcaccccgccggaagcagtgcaagaagcagcagctagagttggccaagaagtacctgcagctcctgcggacctctgcccagcagcgctacaggagccaaatccctgggtcagggcagccccacgccttccaccaggtctatgtccctccaatcctgcgccgggccacagcatccttagacactccggagggggccattatgggggacgtcaaggtggaagatggtgctgacgtgagcatctcggacctcttcaacaccagggttaacaagggcccgagggtgaccgtgcttttggggaaggctggcatgggcaagaccacgctggcccaccggctctgccagaagtgggcagagggccatctgaactgtttccaggccctgttcctttttgaattccgccagctcaacttgatcacgaggttcctgacaccgtccgagctcctttttgatctgtacctgagccctgaatcggaccacgacactgtcttccagtacctggagaagaacgctgaccaagtcctgctgatctttgatgggctagatgaggccctccagcctatgggtcctgatggcccaggcccagtcctcacccttttctcccatctctgcaatgggaccctcctgcctggctgccgggtgatggctacctcccgtccagggaagctgcctgcctgcctgcctgcagaggcagccatggtccacatgttgggctttgatgggccacgggtggaagaatatgtgaatcacttcttcagcgcccagccatcgcgggagggggccctggtggagttacagacaaatggacgtctccgaagcctgtgtgcggtgcccgcactgtgccaagtcgcctgtctctgcctccaccatctgcttcctgaccacgccccaggccagtctgtggccctcctgcccaacatgactcagctctatatgcagatggtgctcgccctcagcccccctgggcacttgcccacctcgtccctactggacctgggggaggtggccctgaggggcctggagacagggaaggttatcttctatgcaaaagatattgctccacccttgatagcttttggggccactcacagcctgctgacttccttctgcgtctgcacaggccctgggcaccagcagacaggctatgctttcacccacctcagcctgcaggagtttcttgctgccctgcacctgatggccagccccaaggtgaacaaagacacacttacccagtatgttaccctccattcccgctgggtacagcggaccaaagctagactgggcctctcagaccacctccccaccttcctggcgggcctggcatcctgcacctgccgccccttccttagccacctggcgcagggcaatgaggactgtgtgggtgccaagcaggctgctgtagtgcaggtgttgaagaagttggccacccgcaagctcacagggccaaaggttgtagagctgtgtcactgtgtggatgagacacaggagcctgagctggccagtctcaccgcacaaagcctcccctatcaactgcccttccacaatttcccactgacctgcaccgacctggccaccctgaccaacatcctagagcacagggaggcccccatccacctggattttgatggctgtcccctggagccccactgccctgaggctctggtaggctgtgggcagatagagaatctcagctttaagagcaggaagtgtggggatgcctttgcagaagccctctccaggagcttgccgacaatggggaggctgcagatgctggggttagcaggaagtaaaatcactgcccgaggcatcagccacctggtgaaagctttgcctctctgtccacagctgaaagaagtcagttttcgggacaaccagctcagtgaccaggtggtgctgaacattgtggaggttctccctcacctaccacggctccggaagcttgacctgagcagcaacagcatctgcgtgtcaaccctactctgcttggcaagggtggcagtcacgtgtcctaccgtcaggatgcttcaggccagggaggcggacctcatcttccttctttccccgcccacagagacaactgcagagctacaaagagctccagacctgcaggaaagtgacggccagaggaaaggggctcagagcagaagcttgacgctcaggctgcagaagtgtcagctccaggtccacgatgcggaggccctcatagccctgctccaggaaggccctcacctggaggaagtggacctctcagggaaccagctggaagatgaaggctgtcggctgatggcagaggctgcatcccagctgcacatcgccaggaagctggacctcagtaacaacgggctttctgtggccggggtgcattgtgtgctgagggccgtgagtgcgtgctggaccctggcagagctgcacatcagcctgcagcacaaaactgtgatcttcatgtttgcccaggagccagaggagcagaaggggccccaggagagggctgcatttcttgacagcctcatgctccagatgccctctgagctgcctctgagctcccgaaggatgaggctgacacattgtggcctccaagaaaagcacctagagcagctctgcaaggctctgggaggaagctgccacctcggtcacctccacctcgacttctcaggcaatgctctgggggatgaaggtgcagcccggctggctcagctgctcccagggctgggagctctgcagtccttgaacctcagtgagaacggtttgtccctggatgccgtgttgggtttggttcggtgcttctccactctgcagtggctcttccgcttggacatcagctttgaaagccaacacatcctcctgagaggggacaagacaagcagggatatgtgggccactggatctttgccagacttcccagctgcagccaagttcttagggttccgtcagcgctgcatccccaggagcctctgcctcagtgagtgtcctctggagcccccaagcctcacccgcctctgtgccactctgaaggactgcccgggacccctggaactgcaattgtcctgtgagttcctgagtgaccagagcctggagactctactggactgcttacctcaactccctcagctgagcctgctgcagctgagccagacgggactgtccccgaaaagccccttcctgctggccaacaccttaagcctgtgtccacgggttaaaaaggtggatctcaggtccctgcaccatgcaactttgcacttcagatccaacgaggaggaggaaggcgtgtgctgtggtctctcagcaaacctgctgggcgacagcggactcagatgccttctggaatgtctgccgcaggtgcccatctccggtttgcttgatctgagtcacaacagcatttctcaggaaagtgccctgtacctgctggagacactgccctcctgcccacgtgtccgggaggcctcagtgaacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagggtgcaggagccgtgggcggacagagccagggttctctccctgttagaagtctgcgcccaggcctcaggcagtgtcactgaaatcagcatctccgagacccagcagcagctctgtgtccagctggaatttcctcgccaggaagagaatccagaagctgtggcactcaggttggctcactgtgaccttggagcccaccacagccttcttgtcgggcagctgatggagacatgtgccaggctgcagcagctcagcttgtctcaggttaacctctgtgaggacgatgatgccagttccctgctgctgcagagcctcctgctgtccctctctgagctgaagacatttcggctgacctccagctgtgtgagcaccgagggcctcgcccacctggcatctggtctgggccactgccaccacttggaggagctggacttgtctaacaatcaatttgatgaggagggcaccaaggcgctgatgagggcccttgaggggaaatggatgctaaagaggctggacctcagtcaccttctgctgaacagctccaccttggccttgcttactcacagactaagccagatgacctgcctgcagagcctcagactgaacaggaacagtatcggtgatgtcggttgctgccacctttctgaggctctcagggctgccaccagcctagaggagctggacttgagccacaaccagattggagacgctggtgtccagcacttagctaccatcctgcctgggctgccagagctcaggaagatagacctctcagggaatagcatcagctcagccgggggagtgcagttggcagagtctctcgttctttgcaggcgcctggaggagttgatgcttggctgcaatgccctgggggatcccacagccctggggctggctcaggagctgccccagcacctgagggtcctacacctaccattcagccatctgggcccaggtggggccctgagcctggcccaggccctggatggatccccccatttggaagagatcagcttggcggaaaacaacctggctggaggggtcctgcgtttctgtatggagctcccgctgctcagacagatagacctggtttcctgtaagattgacaaccagactgccaagctcctcacctccagcttcacgagctgccctgccctggaagtaatcttgctgtcctggaatctcctcggggatgaggcagctgccgagctggcccaggtgctgccgcagatgggccggctgaagagagtggacctggagaagaatcagatcacagctttgggggcctggctcctggctgaaggactggcccaggggtctagcatccaagtcatccgcctcccaatctgcaga

SEQ ID NO: 1547 - DNA, 2501 bp, Artificial Sequence; identical to SEQ ID NO: 1164
  Synthetic polypeptide

SEQ ID NO: 1548 - DNA, 2552 bp, Artificial Sequence; identical to SEQ ID NO: 1165
  Synthetic polypeptide

SEQ ID NO: 1549 - DNA, 2456 bp, Artificial Sequence; identical to SEQ ID NO: 1166
  Synthetic polypeptide

SEQ ID NO: 1550 - DNA, 588 bp, Artificial Sequence; identical to SEQ ID NO: 1167
  Synthetic polypeptide

SEQ ID NO: 1551 - DNA, 2161 bp, Artificial Sequence; identical to SEQ ID NO: 288
  Synthetic polypeptide

SEQ ID NO: 1552 - DNA, 2140 bp, Artificial Sequence; identical to SEQ ID NO: 289
  Synthetic polypeptide

SEQ ID NO: 1553 - DNA, 529 bp, Artificial Sequence; identical to SEQ ID NO: 287
  Synthetic polypeptide

SEQ ID NO: 1554 - DNA, 1736 bp, Artificial Sequence; identical to SEQ ID NO: 156
  Synthetic polypeptide

SEQ ID NO: 1555 - DNA, 1724 bp, Artificial Sequence; identical to SEQ ID NO: 157
  Synthetic polypeptide

SEQ ID NO: 1556 - DNA, 1692 bp, Artificial Sequence; identical to SEQ ID NO: 1048
  Synthetic polypeptide

SEQ ID NO: 1557 - DNA, 1695 bp, Artificial Sequence; identical to SEQ ID NO: 1049
  Synthetic polypeptide

SEQ ID NO: 1558 - DNA, 466 bp, Artificial Sequence; identical to SEQ ID NO: 1050
  Synthetic polypeptide

SEQ ID NO: 1559 - DNA, 103 bp, Artificial Sequence; identical to SEQ ID NO: 173
  Synthetic polypeptide

SEQ ID NO: 1560 - DNA, 3881 bp, Artificial Sequence; identical to SEQ ID NO: 1162
  Synthetic polypeptide

SEQ ID NO: 1561 - DNA, 3722 bp, Artificial Sequence; identical to SEQ ID NO: 1163
  Synthetic polypeptide

SEQ ID NO: 1562 - DNA, 577 bp, Artificial Sequence; identical to SEQ ID NO: 1112
  Synthetic polypeptide

SEQ ID NO: 1563 - DNA, 252 bp, Artificial Sequence; identical to SEQ ID NO: 1113
  Synthetic polypeptide

SEQ ID NO: 1564 - DNA, 533 bp, Artificial Sequence; identical to SEQ ID NO: 1098
  Synthetic polypeptide

SEQ ID NO: 1565 - DNA, 572 bp, Artificial Sequence; identical to SEQ ID NO: 159
  Synthetic polypeptide

SEQ ID NO: 1566 - DNA, 1028 bp, Artificial Sequence
  Synthetic polypeptide
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1567 - DNA, 674 bp, Artificial Sequence
  Synthetic polypeptide
atgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1568 - DNA, 752 bp, Artificial Sequence
  Synthetic polypeptide
atggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1569 - DNA, 664 bp, Artificial Sequence
  Synthetic polypeptide
gcccagaccctccacccgggagagtcccaggcgcctttacccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgcctcctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagaaacaaaaacgaaaacaaaaacaaa

SEQ ID NO: 1570 - DNA, 55 bp, Artificial Sequence
  Synthetic polypeptide
ctgctgtgatgtggaggaagaagagctcagaaacaaaaacgaaaacaaaaacaaa

SEQ ID NO: 1571 - DNA, 519 bp, Artificial Sequence
  Synthetic polypeptide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1572 - DNA, 723 bp, Artificial Sequence
  Synthetic polypeptide
atggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcacccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1573 - DNA, 483 bp, Artificial Sequence
  Synthetic polypeptide
atggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1574 - DNA, 516 bp, Artificial Sequence
  Synthetic polypeptide
atgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagatggctgaggacaaggcctctgtgaaagcccaggtgacgtccttgctcggggagctgcaggagagccagagtcgcttggaggctgccactaaggaatgccaggctctggagggtcgg

SEQ ID NO: 1575 - DNA, 117 bp, Artificial Sequence
  Synthetic polypeptide
atggctgaggacaaggcctctgtgaaagcccaggtgacgtccttgctcggggagctgcaggagagccagagtcgcttggaggctgccactaaggaatgccaggctctggagggtcgg

SEQ ID NO: 1576 - DNA, 1097 bp, Artificial Sequence; identical to SEQ ID NO: 1040
  Synthetic polypeptide

SEQ ID NO: 1577 - DNA, 965 bp, Artificial Sequence; identical to SEQ ID NO: 1041
  Synthetic polypeptide

SEQ ID NO: 1578 - DNA, 258 bp, Artificial Sequence; identical to SEQ ID NO: 265
  Synthetic polypeptide

SEQ ID NO: 1579 - DNA, 243 bp, Artificial Sequence; identical to SEQ ID NO: 267
  Synthetic polypeptide

SEQ ID NO: 1580 - DNA, 324 bp, Artificial Sequence; identical to SEQ ID NO: 268
  Synthetic polypeptide

SEQ ID NO: 1581 - DNA, 175 bp, Artificial Sequence
  Synthetic polypeptide
atgaatctgccgccggatcgcccgggactgctttcactttctgtcaggtagctgccctccaggggcagagaagcccagccatggtcaggagagccacccagctgaggcccacctccaccaggattgccacccagctgaaccccacctcagccaggagagccacccagctgagccc

SEQ ID NO: 1582 - DNA, 1049 bp, Artificial Sequence; identical to SEQ ID NO: 224
  Synthetic polypeptide

SEQ ID NO: 1583 - DNA, 639 bp, Artificial Sequence; identical to SEQ ID NO: 1196
  Synthetic polypeptide

SEQ ID NO: 1584 - DNA, 500 bp, Artificial Sequence; identical to SEQ ID NO: 1197
  Synthetic polypeptide

SEQ ID NO: 1585 - DNA, 1346 bp, Artificial Sequence; identical to SEQ ID NO: 1198
  Synthetic polypeptide

SEQ ID NO: 1586 - DNA, 901 bp, Artificial Sequence; identical to SEQ ID NO: 1199
  Synthetic polypeptide

SEQ ID NO: 1587 - DNA, 586 bp, Artificial Sequence; identical to SEQ ID NO: 401
  Synthetic polypeptide

SEQ ID NO: 1588 - DNA, 829 bp, Artificial Sequence; identical to SEQ ID NO: 402
  Synthetic polypeptide

SEQ ID NO: 1589 - DNA, 1060 bp, Artificial Sequence; identical to SEQ ID NO: 403
  Synthetic polypeptide

SEQ ID NO: 1590 - DNA, 730 bp, Artificial Sequence; identical to SEQ ID NO: 406
  Synthetic polypeptide

SEQ ID NO: 1591 - DNA, 496 bp, Artificial Sequence; identical to SEQ ID NO: 408
  Synthetic polypeptide

SEQ ID NO: 1592 - DNA, 1470 bp, Artificial Sequence
  Synthetic polypeptide
atggctgggccgcggggcgcgctgctggcctggtgccgccgccagtgcgagggctaccgcggcgtggagatccgcgacctgagcagctccttccgggacggcctggccttctgcgccatcctgcaccggcaccggcccgacctgctagattttgattcgctttccaaggacaatgtcttcgagaataaccgtttggcctttgaagtggctgagaaggagctggggatccccgctctcctggaccccaatgacatggtctccatgagcgtccctgactgcctcagcatcatgacctatgtgtcccagtattacaaccacttctgcagtcctggccaagctggtgtctcgccacccagaaagggccttgcaccctgttccccgccgtctgtagcacccactccagtggaaccagaagatgtggctcagggcgaggagctctcctcaggcagcctgtcagagcagggcaccggccagacccccagcagcacgtgcgcagcctgccagcagcatgtgcacttggtgcagcgctacctggctgacggcaggctgtaccatcgccactgcttccggtgtcggcggtgctccagcaccctgctccctggggcttatgagaatgggcctgaggagggcacctttgtgtgtgcagaacactgtgccaggctgggcccggggacacggtcggggaccaggcctgggcccttctcacagccaaagcagcagcaccagcagcaactcgcagaagatgccaaggatgttccaggaggcggccccagctccagtgctcctgcaggggctgaggccgatggacccaaggccagccctgaggcccggccgcagatccctaccaagccccgggttcctggcaaactacaggagctggccagcccccctgcgggccgccccacccctgcccccaggaaggcctctgagagcaccaccccagcaccccccacgccccggccccgctccagtctgcagcaggagaacctggtggagcaggctggcagcagcagcctggtgaacgggagactgcacgaactgcctgtccccaagccgagggggacaccgaagccgtccgaggggacaccagcccccaggaaggaccccccatggatcacgctggtgcaggcagaaccaaagaagaagccagccccacttcccccaagcagcagcccggggccaccaagccaggacagcaggcaggtggagaatggaggcaccgaggaggtggcccagccgagcccaacggccagcctggagtccaaaccctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggataat

SEQ ID NO: 1593 - DNA, 202 bp, Artificial Sequence
  Synthetic polypeptide
ctataacccctttgaggaggaggaggaggacaaggaggaagaggctccagctgcacccagcctggccaccagccctgccctgggccacccggagtccacacccaagtccctgcacccctggtacggcatcacccctaccagcagccccaagacaaagaagcgccctgccccgcgcgcacccagcgcgtccccactggataat

SEQ ID NO: 1594 - DNA, 2451 bp, Artificial Sequence
  Synthetic polypeptide
atggctgtgaggcaggcggcgacggcgggcactcccgggcccaggagagaggaagaggcggcgcttctattcgagagggcccattaccggcacgacccgcgctggctgctgcccgtgaccccccgcctgtgcctggcctgcgcgctggagctgctgccggaccccggcgtgtcgttagtgcgcaagaagcacatgttgtcctgcttccaagatgcccttgtgaggcatacctccctggtcacgcaactggtgtctcaggatcagagagtctgcatccacttcataagtgtgctttttggactattatgcagcatggaagatgggagtgtgacagacctctgtattgaagtccttattcagatcacaacgcagctgaagctggagcagactatccgttgcctgctggatgagtgccacaaagagctgtgtaacatgccctccatgcgaggcagcctggccaccctgacccttcttggcaagttggtggatgccatccctgctctggcagacgagcttgtaatggagcatggcaacctgatggagcatctgttgagaggcttagtataccccagtgagggcatacaagcttctgtctgttacctttatgggaagctatactcctcaccagtggcagctgagatgctttcaggacacttccgtgagaagctttttcccctcttcctttccatcctggatggtgcccagacaaaggagctgcagattaactgcttgggtttgctgaggcagctgttgaagtatgatctctttgtgtccatgatcatgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1595 - DNA, 1671 bp, Artificial Sequence
  Synthetic polypeptide
atgaaccaggatggactgggagaaagtgctaagaatatcgaagggtcatcaggaaatacctcactgcctttggtgctcaaaaagcttctcctctctagagatgaaaccctgcaggtggccagtgctcactgtataactgcggtgcttgtccactccccagcaaagcatgcgtcagccttcatccacgctgacatcccagagttcctctttgagcatctttcttcttccagtgaagtgctcgtctggtccagctgtaactgcttgacactcctggtagaagagccactctttttttccaagtgccacacggtgtatgggatcgaggcagtggtgaggagcctgcagggaagcctgaagatgaacaacatagagctgcacaagcagggcctgctgcttttcgctgaaatcctgacccggcagccagaggagatcaagctgttcacaagctcagccatgtgcagagatgctggccgtgccctccaagaagcagttagcagccctgtgctggaggtggctgctgaggccttgaaggccacttctgcttttctgaggaaggaccatcagagcactccacctgtgcagtatggggaactgcaggctttgctagaagccatgctaaaccgatgtgcggagttttcccagaccttgctgagcaggaggcccctgggccatgcctccagtagagattcagagaaggccattcttcaaaggggaaagttcctcctcagcactctggagggatttagaagtgcctgcaggttggctatagaattccagagtgagccttcagcccaggagaatccattcacagctcccagcgccaagaaggaagacaccttggaggccttctcagaatttcttctcagtgcctgtgactcgctgtgtatccccatggtgatgagacacttggagcagaccacccacccagctttgatggaagttttcctctcaattctacataacctctttgtcatcgttccccacatgaaggagaagttttccaagaagcttgcttcctcatccttcatacgactgaccctggagctgaaggccaggttttgcagtggtctgagtcactcagccctaaaccaggtgtgttccaatttcctctactatatgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1596 - DNA, 555 bp, Artificial Sequence
  Synthetic polypeptide
atgtgcctcaaccttctctcagctccagagaagacaggaccaccttccaaagaagaactctctgcagtgtctgagctcctgcagcatgggctgccccagataagcagcaggagccctgaaagccttgccttcctgtctgatcgccagtacatggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1597 - DNA, 405 bp, Artificial Sequence
  Synthetic polypeptide
atggagggagctgctcgccagagacagtactgcatcctgctcctcttctacttggcctacatccatgaagacaggccgggcgcggtggcttactcctgtaatcccagctctttgggaggccgagatgggcagatcacgaggtcaggagatcgagaccatcatggctaacaaggtaaaaccccgtctctactaaaaatacaaaaaaattagctgggcatggtggtgggtgcctgtagtcccagctactcgggaggctgaggcaggagaatggtgtgaacccgggaggcagagctctcagtgagccgagatcgtgccactgcactccagcctgggcgacagagcgagactccgtctcaaaaaataaataaataaataaataaataaataaaaataaaaatacaaaaa

SEQ ID NO: 1598 - DNA, 722 bp, Artificial Sequence
  Synthetic polypeptide
atgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaagggtgggccaggaggcagattctcatcagatttggaagg

SEQ ID NO: 1599 - DNA, 866 bp, Artificial Sequence
  Synthetic polypeptide
atgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtgcctctgggaaagggaagacgctgtgtcgttttagcagatggattctatgagtggcagcgatgtcagggaacaaaccagaggcagccatacttcatctattttcctcaaatcaagacagagaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaagggtgggccaggaggcagattctcatcagatttggaagg

SEQ ID NO: 1600 - DNA, 740 bp, Artificial Sequence
  Synthetic polypeptide
atgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaagtcaggtagcattggtgctgcagatagtcctgagaactgggagaaagtctgggacaactggaggctgctgacaatggccgggatctttgactgctgggagcccccagagggaggagatgtcctgtattcctataccatcatcacagtggattcctgcaaaggcttgagtgacatccaccacaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaagggtgggccaggaggcagattctcatcagatttggaagg

SEQ ID NO: 1601 - DNA, 492 bp, Artificial Sequence
  Synthetic polypeptide
atgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagacctgaccttctacccacatccgtgacagctcctttcttctagctgcccaggccccagcccaggtaatcttgactccttcctttctctccatttttcagctactttccacaccctccaacattcccattctgaactaaggctatcagcatctctc

SEQ ID NO: 1602 - DNA, 696 bp, Artificial Sequence
  Synthetic polypeptide
atggcggtggcgctgcccagggacttgcggcaggacgccaacctggcaaagaggaggcacgcggagctgtgcaggcagaagcgggtcttcaacgccagaaacaggataattgggggagacactgaagcctgggatgttcaagttcatgaccagaagataaaagaagctactgaaaaagctagacatgaaactttggctgctgaaatgaggcaaaatgacaaaatcatgtgcatattggaaaaccggaaaaagagggataggaaaaatctctgtagggctatcaatgacttccaacagagctttcagaagccagaaactcgccgtgaatttgatctgtccgaccccctagcccttaagaaagatcttccagcccggcagtcagataatgatgttcggaatacgatatcaggaatgcagaaattcatgggagaggatttaaacttccatgagaggaagaaattccaagaggaacaaaacagagaatggtctttgcagcagcaaagggaatggaagaacgcccgtgctgaacaaaaatgcgcagacctgaccttctacccacatccgtgacagctcctttcttctagctgcccaggccccagcccaggtaatcttgactccttcctttctctccatttttcagctactttccacaccctccaacattcccattctgaactaaggctatcagcatctctc

SEQ ID NO: 1603 - DNA, 712 bp, Artificial Sequence; identical to SEQ ID NO: 1187
  Synthetic polypeptide

SEQ ID NO: 1604 - DNA, 523 bp, Artificial Sequence
  Synthetic polypeptide
atgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1605 - DNA, 661 bp, Artificial Sequence
  Synthetic polypeptide
atgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1606 - DNA, 493 bp, Artificial Sequence
  Synthetic polypeptide
atgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1607 - DNA, 463 bp, Artificial Sequence
  Synthetic polypeptide
atgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1608 - DNA, 436 bp, Artificial Sequence
  Synthetic polypeptide
atgtgcttcccgaaggtcctctctgatgacatgaagaagctgaaggcccgaatggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1609 - DNA, 496 bp, Artificial Sequence
  Synthetic polypeptide
atgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1610 - DNA, 595 bp, Artificial Sequence
  Synthetic polypeptide
atgtgcttcccgaaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1611 - DNA, 634 bp, Artificial Sequence
  Synthetic polypeptide
atgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggacgacttcaaagagggctacctggagacagtggcggcttattatgaggagcagcacccagcatcgtgaagaccctgtttctctagctgtgcagctgcaaggtcactaaacagataatctcaagtcataacacaagttgttccttaaaaagtaagaaataatgtaatgcatgtcttgactgaataactatctttgtttctcgcttctgtaatatgcttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatccc

SEQ ID NO: 1612 - DNA, 1747 bp, Artificial Sequence
  Synthetic polypeptide
atggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagatttctggttaccatcagctgggaaaagagaacgaaatcagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaa

SEQ ID NO: 1613 - DNA, 1762 bp, Artificial Sequence
  Synthetic polypeptide
atggatgagctggtacacgacttagcctcagccttggagcagacatctgagcagaataagcttggtgaactgtgggaggagatggcgctgagcccccgacagcagaggcggcagcttcggaaacgccgaggtcggaagcgtcgttctgacttcactcacctggcagagcatacctgctgctacagcgaggcctctgagtcaagtctggatgaggccactaaggactgtcgagaagtggctccggtgaccaattttagtgactctgatgacacaatggtagccaaacgacacccagctctcaatgccattgtcaagagtaagcaacattcttggcatgaatctgactcctttactgaaaatgcaccttgtcgaccactcaggcgcaggcggaaggtgaagcgagtgacatcagaggtggctgctagccttcagcagaagctgaaggtgtcagattggagctatgagagaggctgcaggttcaagtctgctaagaagcagcgtctgtcccgctggaaggagaatactccctggacctcatcaggccacggattgtgtgaatcagcagaaaataggactttcctaagcaaaacaggaaggaaagaaaggatggagtgtgaaacagatgaacaaaaacagggctctgatgagaacatgtcagaatgtgaaaccagcagtgtgtgtagcagcagtgacactgggctctttaccaatgatgaagggcgacaaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagagggtaccatactcgcttgaatcgtctacctggagctgcagctcgatgcctcagaaaggggcgaagaaggctggttgggaaggagaccagcataaacactttggggactgagaggataagccatatcattagtgaccctcggcagaaagaaaagaataaagcgttggcttctgattttcctcacatttctgcttgtgcacatgagttcaatcccctgtctcccctttactccctggatgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaa

SEQ ID NO: 1614 - DNA, 624 bp, Artificial Sequence
  Synthetic polypeptide
atgttcttgccgatgcttctcaccgaaggtgttcaccagcacactgctctgccagacaggcaaatgtacactggggaccaccatgttcacgtgacatcaagaggaagcggaaaccagtggccacagcatctttgtctagccccagtgcagcagcattattcacagtcgtcaaggtggaaacaaatcacatgtccattgctggatgaatggatgaacacaatttgccgtatatatacaatggaatattatgtagcttgaaagcctttcttattcagaatgaaactctgccatgtgctacaaattggatgaagacatttgctaagtcaaataagttagacacaaaaggagaaatattgtgtgattccacttttataagctactagaatagtcaacttcatacaaacagaaaggaacatagtggttgccaggggctaggggaagagggaaatggggggagttattgtttaatgggtacagagtttccatttgagatgatgaaaaagtcctggtgataaatagtggtgacagttatacaacagtgtgaatgtacttaatgcgactgaactgtacagttaaaaatggataagatagcaaattttatgtatattttactataataaaaaa

SEQ ID NO: 1615 - DNA, 965 bp, Artificial Sequence
  Synthetic polypeptide
atgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccaggctccactggcagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatcttcaattcgttcatgcaacctgattcttcctggacactgagcaggagctcaggatacagagggctgtcacaccgagctgttcaacacctaagccattcatggatggcagagccaaaagagcactgactgtaacactccctctgaggcttcatgagttgtgggcatcccccagatgctgctgcagggccagtacacagttgtgctcctgccagtgcccaaaacacacctacccgggctcctgcatccccttgccggcaagctgcacccccaccccaccccacccactggtgagcaattgagcactacaggctgagcgagtgaggcacctctgtcacaagtcttgtgaaggggttagggaaattatcc

SEQ ID NO: 1616 - DNA, 3378 bp, Artificial Sequence; identical to SEQ ID NO: 1228
  Synthetic polypeptide

SEQ ID NO: 1617 - DNA, 952 bp, Artificial Sequence
  Synthetic polypeptide
atgaggccacgatgctgcatcttggctcttgtctgctggataacagtcttcctcctccagtgttcaaaaggaactacagacgctcctgttggctcaggactgtggctgtgccagccgacacccaggtgtgggaacaagatctacaacccttcagagcagtgctgttatgatgatgccatcttatccttaaaggagacccgccgctgtggctccacctgcaccttctggccctgctttgagctctgctgtcccgagtcttttggcccccagcagaagtttcttgtgaagttgagggttctgggtatgaagtctcagtgtcacttatctcccatctcccggagctgtaccagacggcagacaaggggagaagagacgaagcagctggacatcggagactacagttgaacttcggagagaagcaacttgacttcagagggatggctcaatgacatagctttggagaggagcccagctggggatggccagacttcaggggaagaatgccttcctgcttcatcccctttccagctccccttcccgctgagagccactttcatcggcaataaaatcccccacatttaccatcttcaattcgttcatgcaacctgattcttcctggacactgagcaggagctcaggatacagagggctgtcacaccgagctgttcaacacctaagccattcatggatggcagagccaaaagagcactgactgtaacactccctctgaggcttcatgagttgtgggcatcccccagatgctgctgcagggccagtacacagttgtgctcctgccagtgcccaaaacacacctacccgggctcctgcatccccttgccggcaagctgcacccccaccccaccccacccactggtgagcaattgagcactacaggctgagcgagtgaggcacctctgtcacaagtcttgtgaaggggttagggaaattatcc

SEQ ID NO: 1618 - DNA, 459 bp, Artificial Sequence; identical to SEQ ID NO: 237
  Synthetic polypeptide

SEQ ID NO: 1619 - DNA, 2849 bp, Artificial Sequence; identical to SEQ ID NO: 1326
  Synthetic polypeptide

SEQ ID NO: 1620 - DNA, 1925 bp, Artificial Sequence; identical to SEQ ID NO: 1327
  Synthetic polypeptide

SEQ ID NO: 1621 - DNA, 2729 bp, Artificial Sequence; identical to SEQ ID NO: 1328
  Synthetic polypeptide

SEQ ID NO: 1622 - DNA, 2549 bp, Artificial Sequence; identical to SEQ ID NO: 1329
  Synthetic polypeptide

SEQ ID NO: 1623 - DNA, 285 bp, Artificial Sequence
  Synthetic polypeptide
atgtccgcccagaggttaatttctaacagaacctcccagcaatcggcatctaattctgattacacctgggaatatgaatattatgagattggaccagtttcctttgaaggactgaaggctcataaatattccattgtgattggattttgggttggtcttgcagtcttcgtgatttttatgttttttgtgctgaccttgctgaccaagacaggagccccacaccaagatggcctgtcccaacaggaactcacatgggttgagaaaaaaaatttttccttcctgaca

SEQ ID NO: 1624 - DNA, 55 bp, Artificial Sequence; identical to SEQ ID NO: 291
  Synthetic polypeptide

SEQ ID NO: 1625 - DNA, 25 bp, Artificial Sequence
  Synthetic polypeptide
atgagcgtcctttcgtttttttaaa

SEQ ID NO: 1626 - DNA, 1426 bp, Artificial Sequence
  Synthetic polypeptide
atggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggtgggccctaaatccaatgactggtgtccttatgagaagaggagaggccacagagggacacatggagaaggccatggacggcagaggcaggggtcaaggtgacacagccacagccgagggacgcctagagtcacccgaagcggggaggggcaggaaggatcctccttggagccttcggaaggagcggggccctgcccacaccttggtttcagccttctggacatcagaacttcgagggaatccttttctgttacttcgagccaccaggtttgtgtaattcgctactacggcagtcacaggaa

SEQ ID NO: 1627 - DNA, 1108 bp, Artificial Sequence
  Synthetic polypeptide
atgccttttgctcccgttgcccaggctagagtgcaatggcacgatttccgttcactgcaacatctgcttcccgcgttcaagcgattctcctgcctcagccttgggagtagttgggattacagtgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaaatgattaaacagcactttttgcagaaatggaaaaacctgtccttaaattcatatgaagctacaggagaccctaaatagccaaacaatcttgaaaaaggacaaagttggaagactcatatttcctgatttcaaaacatactacaaagctacagtcatcaaaacagtatggcactggcgttaacagtagccatagagaccaatggaatagaattgggggtccaaaacaaatgcatacatctatggccagttggtttttgacaaggaggccaagtttatttaatggagaaagaatagtctcttcaataaatgttgctgggaaacaggatttccttacaaaaaagaatgaagttggattcctacctcacagcatatgtaaaaattaaatcaaaatggatcagtgacctaaatataagggctaaaaccatttataactatcttagaggaaaacataatgataaatcttcatgaccttgaatttgttgatagattcttatataacaacaccaaaagcacaatgaacaaaagaaaaaataaatttgactttatcaaaagtaaaagcttttgtgtttcaaagtacaccatcaagaaagtgaaaaggcaaagcacagaatgggagaaaatattttcaaattatatatctaataagggtttaaggtccagagtagatcaagagcttccaaaactcaacaagaaaaaagacaatccaattttaaatataggcaaagacttgagtaga

SEQ ID NO: 1628 - DNA, 991 bp, Artificial Sequence
  Synthetic polypeptide
atgcctgttaaaagatcactgaagttggatggtctgttagaagaaaattcatttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaaattgaatcaccccagtttaactgaaagcaaagaatctacaacaaaagacaatgatgaaatgattaaacagcactttttgcagaaatggaaaaacctgtccttaaattcatatgaagctacaggagaccctaaatagccaaacaatcttgaaaaaggacaaagttggaagactcatatttcctgatttcaaaacatactacaaagctacagtcatcaaaacagtatggcactggcgttaacagtagccatagagaccaatggaatagaattgggggtccaaaacaaatgcatacatctatggccagttggtttttgacaaggaggccaagtttatttaatggagaaagaatagtctcttcaataaatgttgctgggaaacaggatttccttacaaaaaagaatgaagttggattcctacctcacagcatatgtaaaaattaaatcaaaatggatcagtgacctaaatataagggctaaaaccatttataactatcttagaggaaaacataatgataaatcttcatgaccttgaatttgttgatagattcttatataacaacaccaaaagcacaatgaacaaaagaaaaaataaatttgactttatcaaaagtaaaagcttttgtgtttcaaagtacaccatcaagaaagtgaaaaggcaaagcacagaatgggagaaaatattttcaaattatatatctaataagggtttaaggtccagagtagatcaagagcttccaaaactcaacaagaaaaaagacaatccaattttaaatataggcaaagacttgagtaga

SEQ ID NO: 1629 - DNA, 3934 bp, Artificial Sequence; identical to SEQ ID NO: 1150
  Synthetic polypeptide

SEQ ID NO: 1630 - DNA, 3787 bp, Artificial Sequence; identical to SEQ ID NO: 1151
  Synthetic polypeptide

SEQ ID NO: 1631 - DNA, 867 bp, Artificial Sequence; identical to SEQ ID NO: 1152
  Synthetic polypeptide

SEQ ID NO: 1632 - DNA, 996 bp, Artificial Sequence; identical to SEQ ID NO: 1153
  Synthetic polypeptide

SEQ ID NO: 1633 - DNA, 510 bp, Artificial Sequence
  Synthetic polypeptide
atgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacgggcttcatctgtgaaatgaatgggagtaacagcaacatccacctcacaggttcaggtaagagtaaataacacaaggtacataaagcactcagcacagttcctaccacata

SEQ ID NO: 1634 - DNA, 1977 bp, Artificial Sequence
  Synthetic polypeptide
atggcacagctgcggcccgcggtgccacccggccgtccgcggaggggctcgctgcccgcgggggccagctggcagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1635 - DNA, 2076 bp, Artificial Sequence
  Synthetic polypeptide
atgagcggccggaagcgcagcttcaccttcggggcctacggcggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagatgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1636 - DNA, 2139 bp, Artificial Sequence
  Synthetic polypeptide
atgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagaggttgtcgtccgcggggccgccggctctggaggctgcctgcacgcgctgttctctgctcgctctcaggacggaggccatattggggacgttgcccctctgcccccgggacaggccccagggcgtgcgggatggagtggcggcagctccgatggcactcagcacctgctttggggcctgtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1637 - DNA, 1884 bp, Artificial Sequence
  Synthetic polypeptide
atgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1638 - DNA, 1962 bp, Artificial Sequence
  Synthetic polypeptide
atgattgagaagatgcagggaagcaggatggatgaacaacgctgctccttcccgccgcccctcaaaacagaggaggactacattccatacccgagcgtgcacgaggtcttggggcgagaaggacccttccccctcatcctgctgccccagtttgggggctactggattgagggcaccaaccacgaaatcaccagcatccccgagacagagccactgcagtcgcccacaaccaaggtgaagctcgagtgcaaccccacagcccgcatctaccggaagcactttctcggcaaggagcatttcaattactactcactggacgctgccctcggccaccttgtcttctcactcaagtacgatgtcatcggggaccaagagcacctgcggctgctgctcaggaccaagtgccggacataccatgatgtcatccccatctcctgcctcaccgagttccctaatgttgtccagatggcaaagttggtgtgtgaagacgtcaatgtggatcggttctatcctgtgctctaccccaaggcttcccggctcatcgtcacctttgacgagcatgtcatcagcaataacttcaagtttggcgtcatttatcagaagcttgggcagacctccgaggaagaactcttcagcaccaatgaggaaagtcccgctttcgtggagttccttgaatttcttggccagaaggtcaaactgcaggactttaaggggttccgaggaggcctggacgtgacccacgggcagacggggaccgaatctgtgtactgcaacttccgcaacaaggagatcatgtttcacgtgtccaccaagctgccatacacggaaggggacgcccagcagttgcagcggaagcggcacatcgggaacgacatcgtggctgtggtcttccaggatgagaacactcctttcgtgcccgacatgatcgcgtccaacttcctgcatgcctacgtcgtggtgcaggctgagggcgggggccctgatggccccctctacaaggtctctgtcactgcaagagatgatgtgcccttctttggaccccccctcccggaccccgctgtgttcaggaaggggcctgagttccaggaatttttgctgacaaagctgatcaatgctgaatatgcctgctacaaggcagagaagtttgccaaactggaggagcggacgcgggccgccctcctggagacgctctatgaggaactacacatccacagccagtccatgatgggcttgggcggcgacgaggacaagatggagaatggcagtgggggcggcggcttctttgagtctttcaagcgggtcatccggagccgcagccagtccatggatgccatggggctgagcaacaagaagcccaacaccgtgtccaccagccacagcgggagcttcgcgcccaacaaccccgacctggccaaggcggctggaatatcattgcttattcctgggaaaagtgcgagtagattcggacgccggggcagtgccataggcataggaaccgtggaagagtcactgattgtccctgggaagagccccacgaggaagaagtcgggcccgttcggctcccgccgcagcagcgccattggcatcgagaacatacaggaggtgcaggagaagagggagagccctccggctggtcagaagaccccagacagcgggcacgtctcacaggagcccaagtcggagaactcatccactcagagctccccagagatgcccacgaccaagaacagagcggagaccgcagcgcagagagcagaggcgctcaaggacttctcccgctcctcgtccagtgccagcagcttcgccagcgtggtggaggagacggagggtgtggacggagaggacacaggcctgcctgccttgcctcccagatatcaggctcctgagggcagggcccatgcctgatttatgtcagtggcaagccctggagaacatcagtgaatgtttgttgagtgagtgagt

SEQ ID NO: 1639 - DNA, 1379 bp, Artificial Sequence; identical to SEQ ID NO: 985
  Synthetic polypeptide

SEQ ID NO: 1640 - DNA, 846 bp, Artificial Sequence
  Synthetic polypeptide
atgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactggccaggtgcagtggctcacacctgtatatcccaacactttgggaggccaagatgggtggatcacctgaggtcggaagttcaagaccagcctgatcaacatggagaaaccctgtctctactaaaaatacaaaattagccaggcatggtggcacatgcctgtaatcccagctacctgggaggctgagacagaagaattgcttgaacccgggaagcagaggttgcggtgagtcaagatcacgccattgcactccagcctgggcaacaagaacaaaactccatctaaaaaaaa

SEQ ID NO: 1641 - DNA, 714 bp, Artificial Sequence
  Synthetic polypeptide
atgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaagactacaaaggcatttcttcctgcaatgacgaagaataaccatggccatattgtcactgtggcttcggcagctggacatgtctcggtccccttcttactggcttactggccaggtgcagtggctcacacctgtatatcccaacactttgggaggccaagatgggtggatcacctgaggtcggaagttcaagaccagcctgatcaacatggagaaaccctgtctctactaaaaatacaaaattagccaggcatggtggcacatgcctgtaatcccagctacctgggaggctgagacagaagaattgcttgaacccgggaagcagaggttgcggtgagtcaagatcacgccattgcactccagcctgggcaacaagaacaaaactccatctaaaaaaaa

SEQ ID NO: 1642 - DNA, 681 bp, Artificial Sequence
  Synthetic polypeptide
atgggtgaaaggaaaggggtcaacaagtactatcctccagacttcaaccctgagaagcatggctctctcaaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1643 - DNA, 534 bp, Artificial Sequence
  Synthetic polypeptide
atgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagagcatgagaagaagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1644 - DNA, 270 bp, Artificial Sequence
  Synthetic polypeptide
aagcagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1645 - DNA, 596 bp, Artificial Sequence
  Synthetic polypeptide
caaccgataccacaacagccacccgcttcgggagcgggctcggaagctgtcacagggcatcctcatcatccgattcgaaatgccatataacatctggtgcgatggctgcaagaaccacatcggcatgggtgttcgttacaatgcagaaaagaagaaggtgggcaattactacacaaccccgatctacaggttccggatgaaatgccacctctgtgtcaactacatcgagatgcagacggaccccgccaactgcgactacgtgatcgtgagtggcgcccagcgcaaggaggagcgctgggacatggcggacaatgagcaggtgctgaccacagaagctggagacggacgccatgttccggctggagcatggcgaggccgaccgcagcacactcaagaaggcgctgcccacactgagccacatccaggaggcccagagcgcctggaaggacgacttcgccctcaacagcatgctgcggagaaggttccggaggccagctccaccagggcaagggtttttccctgcctgccactgtatgccgagtgtccagaacaaagcctagcacaaggtgggtatcccagaaatatttgtgggatga

SEQ ID NO: 1646 - DNA, 1261 bp, Artificial Sequence
  Synthetic polypeptide
atggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcatcgactggaccaagatcgagcccagcgtcaacttcctcaagtcgcccaaaggcaacttcagagccacctaaggagtttcacgggccacatgggcagtgagtgccctatgaacagctctctattgaccaacaagagccgcctggtttatggatgacaggcggctttcaaggtgacaggacagcttcctatctggaagaccatcaaagaaggtaaaaacaaatcacctcagcaggttgaattgactggtgtttgtgctacatctcacgggcagtggccaacctgcccgcacagtcagcagaagggcaatggaaaactggcctattagtgatcccactaataggtccacatgggcctgtggacatcattatgggagtcggaggggtacattaaagtaggacgtttgatgttcatcagaagaaccccattccaggatcagggggtgattggattcagtcagtggatattctggtgtgctcacttaaggaggcctcatgatatgagggacatacggggttgccacagtgcagggatggactgagtctagacatgttccccttgcaccctctgaggcacaaaacaccagtaactgttctgtctgtcaacgagaggcttgataggcaagtcacactgaagcctgtagccccaggaagtgtaagtcgtggcaggaacagtcactctgcacactgggctcagcttccctgtggtagatgcaaatgctcacagcacagtaaaaggactggaactca

SEQ ID NO: 1647 - DNA, 1605 bp, Artificial Sequence
  Synthetic polypeptide
atggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggggtcggttccagctctatgcccctctgggacttccagggcagcactatgctcacgagccagtacgtacgtctgacccctgacgagcgcagcaaagagggctctatctggaaccaccagccgtgcttcctcaaagactgggaaatgcacgtccacttcaaagtccacggcacagggaagaagaacctccatggagacggcatcgccttgtggtacacccgggaccgcctcgtgccagggcctgtgtttggaagcaaagataacttccacggcttagccatcttcctggacacctaccccaatgatgagaccactgagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgatgaccgacctggaggacaagaacgagtggaagaactgcattgacatcacgggagtgcgcctgcccaccggctactacttcggggcctccgccggcaccggcgacctgtctgacaatcatgacatcatctccatgaagctgttccagctgatggtggagcacacgcccgacgaggagagcatcgactggaccaagatcgagcccagcgtcaacttcctcaagtcgcccaaaggcaacttcagagccacctaaggagtttcacgggccacatgggcagtgagtgccctatgaacagctctctattgaccaacaagagccgcctggtttatggatgacaggcggctttcaaggtgacaggacagcttcctatctggaagaccatcaaagaaggtaaaaacaaatcacctcagcaggttgaattgactggtgtttgtgctacatctcacgggcagtggccaacctgcccgcacagtcagcagaagggcaatggaaaactggcctattagtgatcccactaataggtccacatgggcctgtggacatcattatgggagtcggaggggtacattaaagtaggacgtttgatgttcatcagaagaaccccattccaggatcagggggtgattggattcagtcagtggatattctggtgtgctcacttaaggaggcctcatgatatgagggacatacggggttgccacagtgcagggatggactgagtctagacatgttccccttgcaccctctgaggcacaaaacaccagtaactgttctgtctgtcaacgagaggcttgataggcaagtcacactgaagcctgtagccccaggaagtgtaagtcgtggcaggaacagtcactctgcacactgggctcagcttccctgtggtagatgcaaatgctcacagcacagtaaaaggactggaactca

SEQ ID NO: 1648 - DNA, 518 bp, Artificial Sequence
  Synthetic polypeptide
atggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgc

SEQ ID NO: 1649 - DNA, 3992 bp, Artificial Sequence; identical to SEQ ID NO: 120
  Synthetic polypeptide

SEQ ID NO: 1650 - DNA, 3845 bp, Artificial Sequence; identical to SEQ ID NO: 121
  Synthetic polypeptide

SEQ ID NO: 1651 - DNA, 500 bp, Artificial Sequence; identical to SEQ ID NO: 204
  Synthetic polypeptide

SEQ ID NO: 1652 - DNA, 656 bp, Artificial Sequence; identical to SEQ ID NO: 205
  Synthetic polypeptide

SEQ ID NO: 1653 - DNA, 524 bp, Artificial Sequence; identical to SEQ ID NO: 207
  Synthetic polypeptide

SEQ ID NO: 1654 - DNA, 1747 bp, Artificial Sequence
  Synthetic polypeptide
atggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgccatcgtcgtcgtcggagatgggcagccaagacgggtcgccgctacgcgagacgcgcaaagacccgttctccgccgcagcggccgagtgctcctgccgccaggatgggctcacggtcatcgtcacggcctgtctcaccttcgctaccggtgtcaccgtggcgctggtcatgcagatctacttcggggacccccagatcttccagcagggtgccgtggtgaccgatgctgcccgctgcacttcactgggcatcgaggtgctcagtaaacagggatcttctgtggacgcagcggtggcagcagccttgtgtttgggtatcgtggctccacacagttctggcctgggcggtgggggcgtgatgctggtacatgacatccgacgaaatgagagccacctaattgatttccgggagtccgcaccaggggccctcagggaagagaccctgcaaagatcctgggagaccaagcctgggctcttggtgggggttcccggaatggtgaaggggctacatgaagctcaccagctctatggcaggctgccatggtcccaagtcctggcctttgcagcagctgtggcccaagatggcttcaacgtgactcatgatctagcccgtgccctggctgaacagctgccacccaacatgtccgagcgcttccgggagacgttcctgccatcgggccgcccgccactacctggctcgttgctgcatcggcccgacctggctgaggtgctggatgtacttggcacctccggcccggctgccttctacgcaggtggcaacctcacactggagatggtggccgaggctcagcacgcagggggtgtcataaccgaagaggacttcagcaattacagcgcccttgtggagaagcctgtgtgtggcgtgtacagaggccacctggttcttagtcccccacctccgcacacgggccctgccctcatcagtgctctcaacatcctggagggcttcaatctcaccagcctggtatcccgagaacaggctcttcactgggtggcagagaccctgaagattgcattagccctggccagcagactgggagatcccgtctatgattctaccatcactgagagcatggatgacatgctcagcaaggtggaggccgcctacctccggggccatatcaatgactcccaggcagcccctgccccactcctgcctgtctatgaactagacggagctcccacggctgcccaggtgctgatcatgggacctgatgacttcattgtggccatggttagctccctgaaccagccctttggcagcggccttatcaccccctcggggatcctgctcaacagccagatgctggacttctcctggcccaaccggacagctaaccactctgcacccagcctggagaattcagtgcagccagggaagcggccactctctttcctgctgcccacagtggtccgacccgcggaggggctctgtggaacctacctcgctctgggggccaatggagctgcgcggggcctcagcggcctgacacagggctgttaggaggctcagatga

SEQ ID NO: 1655 - DNA, 1081 bp, Artificial Sequence; identical to SEQ ID NO: 986
  Synthetic polypeptide

SEQ ID NO: 1656 - DNA, 1054 bp, Artificial Sequence; identical to SEQ ID NO: 987
  Synthetic polypeptide

SEQ ID NO: 1657 - DNA, 235 bp, Artificial Sequence
  Synthetic polypeptide
atgagtgccaacaccttcggcaatgccggcttttccgttctcctgcctggggcccggctcgagggccgctgtgggcccaccaatgcccgggtcagatgccatctggcagctactcaggaggctgagacacgagaatcacttgaacctgggaagcagagtgagctgagatcacaccactccactccagcctgggtgagagagtgagactttgtctcaaaaaaaaaaaaaaaaaaaa

SEQ ID NO: 1658 - DNA, 1078 bp, Artificial Sequence
  Synthetic polypeptide
atgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctggcagctactcaggaggctgagacacgagaatcacttgaacctgggaagcagagtgagctgagatcacaccactccactccagcctgggtgagagagtgagactttgtctcaaaaaaaaaaaaaaaaaaaa

SEQ ID NO: 1659 - DNA, 413 bp, Artificial Sequence
  Synthetic polypeptide
atggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtggtttctaagcttatggatatgcaagggcatacagagtggtataatgtacattggagactcagaaggctggcaagcaggagagaggtgagagatgaaaaagtacctattggatatagtgttcaggtggtgggtgcactaaaattctagacttctccatggtaccgttcatccatgtaaccaaaaaatcactcatacccctaaagctactgaaataaaaaaa

SEQ ID NO: 1660 - DNA, 1825 bp, Artificial Sequence
  Synthetic polypeptide
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctgatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 1661 - DNA, 1825 bp, Artificial Sequence
  Synthetic polypeptide
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctgatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 1662 - DNA, 935 bp, Artificial Sequence
  Synthetic polypeptide
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggccaaagtgcccgccttgcagggtccttggcagatgagatgacctaacgtggcaaagtggttagaccagcg

SEQ ID NO: 1663 - DNA, 641 bp, Artificial Sequence
  Synthetic polypeptide
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggccaaagtgcccgccttgcagggtccttggcagatgagatgacctaacgtggcaaagtggttagaccagcg

SEQ ID NO: 1664 - DNA, 2362 bp, Artificial Sequence
  Synthetic polypeptide
atggatgatgtcctgcccctgatgccttgggagaccctgttggcacagggcagtccccagggctcgcctgacctcccagcagggcagcggaagcagcagccacagggtgacagggcccagggcctggcctctgagtcctggaagctcctggaggtgcccatcattcacataacgccatccagtgatggggagtcccccgcctgcaccccaaccccccgacgccggcagcagcagaggatgccagacccgcagagtctgtcccaggacagcaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1665 - DNA, 2113 bp, Artificial Sequence
  Synthetic polypeptide
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagaagatgcagagctggtacagtatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtgatctgtgtgagccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1666 - DNA, 1399 bp, Artificial Sequence
  Synthetic polypeptide
atgcactgcttgaaaaggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1667 - DNA, 2080 bp, Artificial Sequence
  Synthetic polypeptide
atgttcgacaccacaccccactctggccggagcacgccaagcagctccccatcgctccggaaacggctgcagctcctgcccccaagccggcccccacctgagccagaaccaggcaccatggtggagaagggatcagatagctcctcagagaagggtggggtgcctgggacccccagcacccagagcctaggcagccggaacttcatccgcaacagcaagatgctgagccccacttataagcagcgtaatgaggacttccggaaactgttcagcaaactccccgaagcagaacgcctcattgtggattactcctgcgccctgcagcgtgagatcctgctccagggccgcctctacctctctgagaactggatctgcttctacagcaacatcttccgctgggagaccacgatctccatccagctgaaggaagtgacatgtctgaagaaggaaaagacggccaagctgatccccaacgccatccagatctgcacggagagcgagaagcatttcttcacttcctttggggcccgtgaccgctgcttcctcctcatcttccgcctctggcagaatgcactgcttgaaaagacgctgagtccccgcgagctctggcacctggtgcatcagtgctacggctcagagctgggcctcaccagtgaggatgaggactatgtctcccccttgcagctgaacggtctggggacccccaaggaagtgggagatgtgatcgccctgagcgacatcacctcctcgggggcagctgaccgcagccaggagccaagcccagtgggttcgcgccgtggccatgtcacgcccaacctttcccgagccagcagcgacgcagaccatggggcagaggaggacaaggaggagcaggtagacagccagccagacgcctcctccagccagacagtgaccccggtggctgaacccccgagcacagagcccacccagcctgacgggcccaccaccctgggccccttggatctgctgcccagtgaggagctattgacagacacaagtaactcctcttcatccactggggaggaagcggacttggctgccctgcttcccgacctctccggccgcctcctcatcaactctgtcttccatgtgggcgctgagcggctccagcagatgctcttctcggactcgcccttcctccagggcttcctacagcagtgcaagttcacagacgtgacgctgagcccctggagtggggacagcaagtgccaccagcgccgggtgctgacgtacaccatccccatcagcaacccactgggccccaagagcgcctccgtggtggagacacagacgctgttccggcgcggcccccaggccggcgggtgtgtggtggactccgaggtgctgacgcagggcatcccctaccaggactacttctacactgcccaccgctactgcatcctgggtctggcccggaacaaggcgcggctccgagtgtcttctgagatccgctaccgaaagcagccgtggagcctggtgaagtcgctcattgagaagaactcgtggagcggcattgaagactatttccaccatctggagcgagagctcgccaaggctgagaagctgtctctggaggaaggcgggaaggatgcccggggcttgctatccggcctgcggcggcggaagcggcccctgagctggcgggctcacggggacgggccccagcacccagatcctgacccctgtgcccgggccggcattcacacctcgggctccctcagctcccgcttctccgaaccatctgtggaccagggccccggggcaggcatccccagtgccctggttctcatcagcattgtccttatcatcctcatcgccctcaacgtcctgctcttctaccgcctctggtccctggaaaggacagcccacacctttgagtcctggcacagcctggccctggccaagggcaagttcccccagacggccacagagtgggccgagatcctggcgctgcagaagcaattccacagcgtggaggtgcacaagtggaggcagatcctgcgggcctccgtggagctcctggatgagcattgcaggggaaagcatggaagcatggatg

SEQ ID NO: 1668 - DNA, 1221 bp, Artificial Sequence; identical to SEQ ID NO: 122
  Synthetic polypeptide

SEQ ID NO: 1669 - DNA, 193 bp, Artificial Sequence; identical to SEQ ID NO: 975
  Synthetic polypeptide

SEQ ID NO: 1670 - DNA, 3961 bp, Artificial Sequence
  Synthetic polypeptide
atggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaacacggattctcgtgacgcacgcactccacatcctgccccaggctgattggatcatagtgctggcaaatggggccatcgcagagatgggttcctaccaggagcttctgcagaggaagggggccctcatgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaagaccggatgatgggcacactggagcaaggactctttaatttctatacttccggtgcctaaacaggtacttggcatacagt

SEQ ID NO: 1671 - DNA, 37 bp, Artificial Sequence
  Synthetic polypeptide
atggtggcccgggtgtggtcgctgatgaggtgggaat

SEQ ID NO: 1672 - DNA, 369 bp, Artificial Sequence
  Synthetic polypeptide
gcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggagcatcacttgaagctcggagtttgagaccagcctgggcaacatagcaagaccccacccatttctacaaagaaacaagaa

SEQ ID NO: 1673 - DNA, 410 bp, Artificial Sequence
  Synthetic polypeptide
atggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggctgaggcaggagcatcacttgaagctcggagtttgagaccagcctgggcaacatagcaagaccccacccatttctacaaagaaacaagaa

SEQ ID NO: 1674 - DNA, 514 bp, Artificial Sequence
  Synthetic polypeptide
atggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgc

SEQ ID NO: 1675 - DNA, 8540 bp, Artificial Sequence
  Synthetic polypeptide
atgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtccccctcccttgggtccccagagccacgcacatccagccctgcttcccacacacggggccgtgcgtgcctttcttcaccactgagctccttcaagggcagggactgtctttatctttgcatcccccgctgcaccctgtgcctgcccactgggcactcggtggatg

SEQ ID NO: 1676 - DNA, 734 bp, Artificial Sequence; identical to SEQ ID NO: 930
  Synthetic polypeptide

SEQ ID NO: 1677 - DNA, 1490 bp, Artificial Sequence
  Synthetic polypeptide
atggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1678 - DNA, 1451 bp, Artificial Sequence
  Synthetic polypeptide
atgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1679 - DNA, 926 bp, Artificial Sequence
  Synthetic polypeptide
atgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1680 - DNA, 1451 bp, Artificial Sequence
  Synthetic polypeptide
atggcttctccgtggcgcggagcccatgaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgacc

SEQ ID NO: 1681 - DNA, 314 bp, Artificial Sequence; identical to SEQ ID NO: 998
  Synthetic polypeptide

SEQ ID NO: 1682 - DNA, 2466 bp, Artificial Sequence
  Synthetic polypeptide
atgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1683 - DNA, 1806 bp, Artificial Sequence
  Synthetic polypeptide
atgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1684 - DNA, 2412 bp, Artificial Sequence
  Synthetic polypeptide
atgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1685 - DNA, 2211 bp, Artificial Sequence
  Synthetic polypeptide
atgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1686 - DNA, 364 bp, Artificial Sequence
  Synthetic polypeptide
ttgcagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaaggccgggtacggtggcctggaatcccaacacttcggaaggctgaggcaggagaattgcttgagcccaggagttcaagaccagcctgggcaacatagcaagaccccatctctacaaaacaaacaaaaa

SEQ ID NO: 1687 - DNA, 5110 bp, Artificial Sequence
  Synthetic polypeptide
atgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaa

SEQ ID NO: 1688 - DNA, 436 bp, Artificial Sequence
  Synthetic polypeptide
aacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagacgaagagaaccagaaacaatgccaggacctcggcgccttcaccgagagcatggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaa

SEQ ID NO: 1689 - DNA, 133 bp, Artificial Sequence
  Synthetic polypeptide
atggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1690 - DNA, 874 bp, Artificial Sequence
  Synthetic polypeptide
atgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1691 - DNA, 961 bp, Artificial Sequence
  Synthetic polypeptide
atgctgcctttagaacgaactatcacttacagagacatgtcttcattcatacaggtgaaaaaccatttcaatgtagtcaatgtgacatgcgtttcatacagaagtacctgcttcagagacatgagaagattcatactggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1692 - DNA, 520 bp, Artificial Sequence
  Synthetic polypeptide
ctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1693 - DNA, 277 bp, Artificial Sequence
  Synthetic polypeptide
atgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccccgggctccctggcagctgttggcatctcgaagaagcttctctgcccttcattgggtaggtgtgaagaggcaaagagat

SEQ ID NO: 1694 - DNA, 1731 bp, Artificial Sequence; identical to SEQ ID NO: 989
  Synthetic polypeptide

SEQ ID NO: 1695 - DNA, 2262 bp, Artificial Sequence; identical to SEQ ID NO: 990
  Synthetic polypeptide

SEQ ID NO: 1696 - DNA, 2253 bp, Artificial Sequence; identical to SEQ ID NO: 991
  Synthetic polypeptide

SEQ ID NO: 1697 - DNA, 3992 bp, Artificial Sequence; identical to SEQ ID NO: 120
  Synthetic polypeptide

SEQ ID NO: 1698 - DNA, 3845 bp, Artificial Sequence; identical to SEQ ID NO: 121
  Synthetic polypeptide

SEQ ID NO: 1699 - DNA, 1598 bp, Artificial Sequence
  Synthetic polypeptide
atgcagggcgaagagagcctccggatcctggtggagcccgaaggggacagcttcccgctgatggagatcagcacctgtgagaccgaggcctccgagcagtgggactatgtcctcgtggcccaacgtcacacccagagagacccccggcaggcgcggcagcaacagttcctggaggagctcaggagaaagggcttccacattaaggtgatccgggaccagaaacaggtcttctttgggatccgtgctgacaacagtgtctttggcctgtaccgcactttcctcctggagcctgaggggcctgccccccacgccgagctggccgcgccgaccaccatcccggtcaccacgagtctcagaatccgaatcgtgaacttcgttgtcatgaacaacaagacctcggctggtgagaccttcgaggatctgatgaaggacggggtctttgaggccaggttccccctgcacaagggggagggacgcctgaagaagacgtgggcgcggtggagacacatgttccgggagcagccagttgatgaaatcaggaactactttggggaaaaggtggccctgtacttcgtctggctgggctggtacacctacatgctggtgccggccgccctgacgggcctcttagtctttctgagcggattctcgctgtttgaggccagccagatcagcaaggagatctgtgaggcccacgacatcctcatgtgtcccctcggcgaccacagccgcaggtaccagcggctctcggaaacctgcacttttgccaagctcacccacctctttgacaatgatggcacggtggtgttcgccatcttcatggctctctgggccacggtgttcctggagatctggaagcggcagcgcgcccgcgtggtcctgcactgggacctgtacgtgtgggacgaggaacaggaggaaatggcacttcagctcattaactgccccgactacaagctccggccataccagcactcctacctacgcagcaccgtcatcctcgtcctgaccctgctcatgatctgcctcatgatcggcatggcccacgtcctggtggtctaccgcgtcctggcctccgcgctcttcagcagctcggccgtgcccttcctggaggagcaggtgaccacggccgtggtggtgaccggggctctggtgcactatgtgaccatcatcatcatgaccaagatcaacaggtgcgtggccctgaagctttgtgacttcgagatgcccaggaccttctcggagcgagagagcaggttcaccatccgcttcttcacactgcagttcttcacccatttctcgtctctcatctacatcgccttcatcctgggcaggtgcagtggcttatgcctgaaatcccagcactttgggaggctgaggcaggcagatcacctgaggtcaggagttcaagaccagactggccaacatgaagaaaccccgtctctactagccaggcgtggtggtgtgagcctgtagtcccagctactcgggaggctgaggcacaagaatcacttgaacccaggaggcagaggttgcagtgaactgaaatcgcaccattgcgctccagcctgggtgacagagtgaggctccatctcaaa

SEQ ID NO: 1700 - DNA, 640 bp, Artificial Sequence
  Synthetic polypeptide
atggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaa

SEQ ID NO: 1701 - DNA, 559 bp, Artificial Sequence
  Synthetic polypeptide
atggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgccaggagccgtggctcacacctgtaaacccagcactttgggaagccgaggcaggaggattgcttgagcccaggagttcaagaccagcctaggcaacatggcaagaccccatctctacaaaagtaacaaaa

SEQ ID NO: 1702 - DNA, 225 bp, Artificial Sequence
  Synthetic polypeptide
atggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcctggacaacagagtgagaccctgtgtcaaaaaa

SEQ ID NO: 1703 - DNA, 1168 bp, Artificial Sequence
  Synthetic polypeptide
atgtcagacaacaaagaaaggaagagtcaaggatttcctaaagaagataaccaagacacaagttcattagctgatgctgtagagaaagttgcaaagcaacaacaatcacaagcatcagagatagaaaaaaacaaaaaggttctgttcaatttgaagaatgaacttcatgagcttgaaaaagaaatagcagctatctctgcagaaactaaagaaacagaaagacaaatttatcaacaagattctgccatagagaataccaaacttcattgtgatagcctggaaactcaaatcaaatccttacattcagaaaatgtaaagcttaaatttgacatagaaacagcccaagaagattttgaggaacacatgataaaatataatgcatattatgcaaaaataaaagcacataaaaatagtttgggggaagtagagagcaaatggtcatttatgactgaactccatgaaaagcgagattttgttaaaaaattaaagacaatgaaagaagaacttatgcaagatcttcaaaatccaggagggaaccgaataacacaagtacaggaagacattacaaacttaaaggataaaattataactgtaaaagaatctatcattgaaaaaacttgttttcttgaggaagaaaaaaagacacatgaaaaattaagaaaagaaatagagaccttgcaccacccatccactggagtcatccttgctgaccacaagatatctcttgaaacggagataagcagcatcccactgtaaatcttactcaagggagttaaccttattgcaggcatgtgcacaagaccagaagaatgactgatctttaccctatccctcattataatactgaaattctcacccagggaagagcttatccatcatattttgatcatgcaatgtatgcgctagcatgatttctcattgtgcctgcacaccctgtgctccacccggcacatgtaatgacacttccatacctcatgcacattcctgtcacctttcctagaaacaccacaaagacctgccctcagaaagccagccagctaactcttgctcctgcactgtctccattgtgttcaaacataagcccccaataaaagccttgtttgggaaacttgctcagccttgtgtcaatttctattaaatgagagcctaagaacctgtggttggtaac

SEQ ID NO: 1704 - DNA, 412 bp, Artificial Sequence
  Synthetic polypeptide
atgaggacgctgctgaccatcttgactgtgggatccctggctgctcacgcccctgaggacccctcggatctgctccagcacgtgaaattccagtccagcaactttgaaaacatcctgacgtgggacagcgggccggagggcaccccagacacggtctacagcatcgagtataagacgtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacagaagaagacccacagcattcatcacattctcaaaggagtctgtaaaccagcaaaggt

SEQ ID NO: 1705 - DNA, 725 bp, Artificial Sequence
  Synthetic polypeptide
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggcaccatgaactgcacccataaaagacagtgaatttaatccgtaaatattgtgtgtgttctggctgctccaccaactggccattaccaccccctgccaccgccgccccgttccctgagacacaacaatattgaaattaggccacttaatagccctccattggcctccaagtg

SEQ ID NO: 1706 - DNA, 815 bp, Artificial Sequence
  Synthetic polypeptide
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggcaccatgaactgcacccataaaagacagtgaatttaatccgtaaatattgtgtgtgttctggctgctccaccaactggccattaccaccccctgccaccgccgccccgttccctgagacacaacaatattgaaattaggccacttaatagccctccattggcctccaagtg

SEQ ID NO: 1707 - DNA, 2466 bp, Artificial Sequence; identical to SEQ ID NO: 1682
  Synthetic polypeptide

SEQ ID NO: 1708 - DNA, 1806 bp, Artificial Sequence; identical to SEQ ID NO: 1683
  Synthetic polypeptide

SEQ ID NO: 1709 - DNA, 2412 bp, Artificial Sequence; identical to SEQ ID NO: 1684
  Synthetic polypeptide

SEQ ID NO: 1710 - DNA, 2211 bp, Artificial Sequence; identical to SEQ ID NO: 1685
  Synthetic polypeptide

SEQ ID NO: 1711 - DNA, 364 bp, Artificial Sequence; identical to SEQ ID NO: 1686
  Synthetic polypeptide

SEQ ID NO: 1712 - DNA, 4024 bp, Artificial Sequence
  Synthetic polypeptide
atggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagctaaacaagcactggcctcaagagaagcaatattaaaacaatttgcagctcaccaccagccgctgactaacggcgcccccctgttccaacagccataactacagctttgattggacaagaggctgatttcagttaacttcctcctgatgagaaaaccacagccatggactgattctggccggtttacagaggctgtgtacttggttgcctttgtgtcctaaaaaggaggtgtagggcctaattgtaatacatgtaaatgttaattctccaccccaaagcacacatggttatatgttacctgcatgtttgttcagtacacatgcctcaggaccaccttcatgagtatttgaagctcttcgtataacctgttgactatgtatgtttggccaacctgttcaactaaaatttctgtctaattcctctctccctcaaagtgcctatttctggtctttgctggaagctacacttcccagctggtaggatggccacttggcaggctgtaaacttttacaagaaataaagtctccttttcgaaatgtatagatcttgtgatttttcagttaac

SEQ ID NO: 1713 - DNA, 4060 bp, Artificial Sequence
  Synthetic polypeptide
atggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagctaaacaagcactggcctcaagagaagcaatattaaaacaatttgcagctcaccaccagccgctgactaacggcgcccccctgttccaacagccataactacagctttgattggacaagaggctgatttcagttaacttcctcctgatgagaaaaccacagccatggactgattctggccggtttacagaggctgtgtacttggttgcctttgtgtcctaaaaaggaggtgtagggcctaattgtaatacatgtaaatgttaattctccaccccaaagcacacatggttatatgttacctgcatgtttgttcagtacacatgcctcaggaccaccttcatgagtatttgaagctcttcgtataacctgttgactatgtatgtttggccaacctgttcaactaaaatttctgtctaattcctctctccctcaaagtgcctatttctggtctttgctggaagctacacttcccagctggtaggatggccacttggcaggctgtaaacttttacaagaaataaagtctccttttcgaaatgtatagatcttgtgatttttcagttaac

SEQ ID NO: 1714 - DNA, 314 bp, Artificial Sequence; identical to SEQ ID NO: 998
  Synthetic polypeptide

SEQ ID NO: 1715 - DNA, 980 bp, Artificial Sequence; identical to SEQ ID NO: 139
  Synthetic polypeptide

SEQ ID NO: 1716 - DNA, 1256 bp, Artificial Sequence; identical to SEQ ID NO: 140
  Synthetic polypeptide

SEQ ID NO: 1717 - DNA, 1277 bp, Artificial Sequence; identical to SEQ ID NO: 142
  Synthetic polypeptide

SEQ ID NO: 1718 - DNA, 1081 bp, Artificial Sequence; identical to SEQ ID NO: 986
  Synthetic polypeptide

SEQ ID NO: 1719 - DNA, 1054 bp, Artificial Sequence; identical to SEQ ID NO: 987
  Synthetic polypeptide

SEQ ID NO: 1720 - DNA, 500 bp, Artificial Sequence; identical to SEQ ID NO: 204
  Synthetic polypeptide

SEQ ID NO: 1721 - DNA, 656 bp, Artificial Sequence; identical to SEQ ID NO: 205
  Synthetic polypeptide

SEQ ID NO: 1722 - DNA, 524 bp, Artificial Sequence; identical to SEQ ID NO: 207
  Synthetic polypeptide

SEQ ID NO: 1723 - DNA, 442 bp, Artificial Sequence
  Synthetic polypeptide
atgaagatgagattcttcagttctccatgtggaaaagcagctgtggacccagtgagataccactacacacccgccaaaatggcgaaacgaaaatgaacaccaccaaacggtggcaaggaggcagcgcacctggaactcccgcacatcgctgatgggagcacaaaatggaacagcactgaagagaggcctggccactcctcaaacacacacctgcccccaaagccagcatatctcctattcgtccaagtgaaacaaaagaacatatcccttaaagtataattaaaaatatatatatatccacacaaacactgtcacagaaacgttcagagcagttttattcacaatcaccaaaagctggaaacagcccaggcatccatcaatggaaaaactgctacatccatccatgggaacctacttgatagtttaaagaaatggcctactt

SEQ ID NO: 1724 - DNA, 117 bp, Artificial Sequence; identical to SEQ ID NO: 928
  Synthetic polypeptide

SEQ ID NO: 1725 - DNA, 51 bp, Artificial Sequence; identical to SEQ ID NO: 929
  Synthetic polypeptide

SEQ ID NO: 1726 - DNA, 1721 bp, Artificial Sequence
  Synthetic polypeptide
atggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagtttcctcatctgcaaagtgaagacgataacacctatttcatggggtcactgtgaagagtggatggtttgtgacatgtcaagagcttagcgtggtgcctggtacatggtaa

SEQ ID NO: 1727 - DNA, 520 bp, Artificial Sequence
  Synthetic polypeptide
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggatctcctcccaaacgaacctcagacatccaggtttctgccttagatctgctttgggg

SEQ ID NO: 1728 - DNA, 312 bp, Artificial Sequence
  Synthetic polypeptide
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggaaacaattgctatcaaagatggaagagaaaagatgaaccaaaatggttgttttctgaaaaattagagcatatttcttcatggagatgaagagtgtttccatatgccttttatgcaaata

SEQ ID NO: 1729 - DNA, 679 bp, Artificial Sequence
  Synthetic polypeptide
atgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcaggttgaaagagaccatggcatctgtcttggatgcatactctctctcgctggctctggggtagccagatgccatgctgtgtgctgccctgtgaagaggcatggccagtaaggaactgagggcaggaaccagggaagatttggggtcctcaggccagctgcccattgggaatgaaactctaccaacagccacctgggggagctggaagtgaatctcatcttagctgagccttctgatgagactgcagccccagctgacacctggattgcagactcatgaaagacc

SEQ ID NO: 1730 - DNA, 1181 bp, Artificial Sequence
  Synthetic polypeptide
atgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagattctttcacaggactggtcaacatcttgacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcaggatcatagatggaaatgactagccttgtctcagatgacacttcgaactttggacttttgagttaatgttggaataagttaagactttcggggactgttgggaaggcaggattgtattttgaaatttgagaaggacataaaatttgggagggggcag

SEQ ID NO: 1731 - DNA, 983 bp, Artificial Sequence
  Synthetic polypeptide
atgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcaggatcatagatggaaatgactagccttgtctcagatgacacttcgaactttggacttttgagttaatgttggaataagttaagactttcggggactgttgggaaggcaggattgtattttgaaatttgagaaggacataaaatttgggagggggcag

SEQ ID NO: 1732 - DNA, 1148 bp, Artificial Sequence
  Synthetic polypeptide
atgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagatattaattggcgattcactggagacttcacggcacctgacctggtttgccgagtggtccgctatttgcaggttgtgctgctctacgcctctacctacgtcctggtgtccctcagcatagacagataccatgccatcgtctaccccatgaagttccttcaaggagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcaggatcatagatggaaatgactagccttgtctcagatgacacttcgaactttggacttttgagttaatgttggaataagttaagactttcggggactgttgggaaggcaggattgtattttgaaatttgagaaggacataaaatttgggagggggcag

SEQ ID NO: 1733 - DNA, 609 bp, Artificial Sequence; identical to SEQ ID NO: 249
  Synthetic polypeptide

SEQ ID NO: 1734 - DNA, 738 bp, Artificial Sequence; identical to SEQ ID NO: 250
  Synthetic polypeptide

SEQ ID NO: 1735 - DNA, 537 bp, Artificial Sequence; identical to SEQ ID NO: 251
  Synthetic polypeptide

SEQ ID NO: 1736 - DNA, 684 bp, Artificial Sequence; identical to SEQ ID NO: 253
  Synthetic polypeptide

SEQ ID NO: 1737 - DNA, 285 bp, Artificial Sequence; identical to SEQ ID NO: 255
  Synthetic polypeptide

SEQ ID NO: 1738 - DNA, 552 bp, Artificial Sequence; identical to SEQ ID NO: 254
  Synthetic polypeptide

SEQ ID NO: 1739 - DNA, 847 bp, Artificial Sequence; identical to SEQ ID NO: 1423
  Synthetic polypeptide

SEQ ID NO: 1740 - DNA, 793 bp, Artificial Sequence; identical to SEQ ID NO: 1424
  Synthetic polypeptide

SEQ ID NO: 1741 - DNA, 418 bp, Artificial Sequence; identical to SEQ ID NO: 1425
  Synthetic polypeptide

SEQ ID NO: 1742 - DNA, 798 bp, Artificial Sequence; identical to SEQ ID NO: 1426
  Synthetic polypeptide

SEQ ID NO: 1743 - DNA, 3723 bp, Artificial Sequence
  Synthetic polypeptide
atgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctggtgaggcccctgcagctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccggaaataggaaaactcaacctaaaactcacatggaatcttaagggatcccaacagccaaaacagtctcaaaaaagaagaacaaagctgaagaacttactgacttcaaaacttactacaaacctacagtaatcaaaatagtgtggtactgccatataaatcaaaagacagacatacaaaccaatggaatagactagaaagaatcccagaaataaaccctcacatatatggtcaaataattttgacaacgatgccaagactatgaaatggggaaaggatagtttttgttttagttttccaacaaatggtgctgggaaaactgaatatttgcatgcaaaagaataaagctgtgcccttacctaataccttatacaaaaattaactcaaaatggatcaaagacctaaatgtagccactgaaactataaaactcatagaagaaaacatggaacaaacccttcatggcactggatttggcagtgattagttcaccaaaggcacaggcacgaaaagaaataatagacaaattagacatcctgaaacttttaaacttttgtgcatcaaaagcaacatcaacagagtaaaaaggcaacccacagaataggagaaaatatttccaaatcatatctctgatgttaatatccagaatatatagagaactcctaaaactcaagaaaacaaacaacccagttcaaaaatgggcagag

SEQ ID NO: 1744 - DNA, 3708 bp, Artificial Sequence
  Synthetic polypeptide
atgaaagatgaggcgggggagagagacagagaagtgagcagcctgaacagcaagctgttaagcctgcaacttgacatcaagaatctgcacgatgtctgcaagagacagaggaagaccttgcaggacaatcagctctgcatggaggaggcaatgaacagcagccacgacaagaagcaagcacaggcattagcattcgaggagtcagaggtggaatttgggtccagtaaacagtgtcatctgagacaactccagcaactgaagaaaaaattgctggtccttcaacaagaactggagtttcacacagaggagttgcagacttcttactattctctccgccagtatcagtccatcctagagaagcagacttccgacctggttcttctgcaccatcactgcaaactgaaagaagatgaggtgattctctatgaggaggaaatgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggaccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccggaaataggaaaactcaacctaaaactcacatggaatcttaagggatcccaacagccaaaacagtctcaaaaaagaagaacaaagctgaagaacttactgacttcaaaacttactacaaacctacagtaatcaaaatagtgtggtactgccatataaatcaaaagacagacatacaaaccaatggaatagactagaaagaatcccagaaataaaccctcacatatatggtcaaataattttgacaacgatgccaagactatgaaatggggaaaggatagtttttgttttagttttccaacaaatggtgctgggaaaactgaatatttgcatgcaaaagaataaagctgtgcccttacctaataccttatacaaaaattaactcaaaatggatcaaagacctaaatgtagccactgaaactataaaactcatagaagaaaacatggaacaaacccttcatggcactggatttggcagtgattagttcaccaaaggcacaggcacgaaaagaaataatagacaaattagacatcctgaaacttttaaacttttgtgcatcaaaagcaacatcaacagagtaaaaaggcaacccacagaataggagaaaatatttccaaatcatatctctgatgttaatatccagaatatatagagaactcctaaaactcaagaaaacaaacaacccagttcaaaaatgggcagag

SEQ ID NO: 1745 - DNA, 3333 bp, Artificial Sequence
  Synthetic polypeptide
atgggaaatcacaacgagaacacaggggagaagctccatttggcgcaggagcaactcgccttggccggggacaagatcgcctctctagagaggagcttaaacctctacagggataaataccagtcttccctgagcaacatcgagttactagaatgccaagtgaagatgttgcagggggaactcggcgggatcatgggtcaggagcctgagaacaagggtgatcattcaaaggtacggatatacacttctccttgcatgattcaagagcatcaggagactcagaaacgactgtctgaagtctggcaaaaggtctctcaacaggatgatctcattcaagaacttcgaaataagctggcctgcagtaacgctttggttctggagcgtgaaaaggctttgataaaactacaagccgattttgcttcctgtacagccacccacagataccctcctagctcctcagaagagtgtgaagacatcaaaaagatactgaagcacttgcaggagcagaaagacagccagtgcctgcatgtggaggagtaccagaacctggtgaaggatctgcgcgtggaactagaggccgtgtcggaacagaagagaaacatcatgaaggacatgatgaagctggagctggacctgcacggactgcgggaggagacatctgcccacattgagaggaaggataaggacatcaccatcctgcagtgccggctgcaggagctgcagctggagttcaccgagacccaaaagctcactttgaagaaagacaagttcctccaagagaaagatgagatgctgcaagagctggagaagaaactgacacaggttcagaacagcctcctgaaaaaggagaaggagctggagaagcagcagtgcatggccacagaacttgaaatgacagtcaaggaggctaagcaggacaagtccaaggaggcggagtgcaaggccctgcaggctgaggtccagaagctgaagaacagtctcgaagaggccaagcagcaggagaggctggctgctcagcaagcagcccagtgcaaagaagaggctgcactggcaggctgtcacctggaggacacccagaggaaactgcagaagggtctcctcctggacaagcagaaggcagacaccatccaggaactacagagagaacttcagatgctgcagaaggagtcctcgatggctgagaaggaacaaacctccaacagaaaacgggtggaggagctgtcattagaactctctgaagccctgaggaagcttgaaaattcagacaaggaaaagaggcagcttcagaagacagtggctgagcaggatatgaaaatgaatgacatgcttgatcgtatcaagcaccagcacagggagcaaggctccatcaaatgcaagttagaagaagatcttcaggaggccacaaagcttctggaggacaaacgggagcagttgaagaagagcaaagagcatgagaagctgatggagggagaacttgaagctttgcggcaggaatttaaaaagaaagacaagacgttgaaagagaattccagaaagttggaggaagaaaatgagaatctccgagcagagctacagtgttgttctacacaactggaatcctctctcaacaaatacaacaccagccagcaagtcatccaagacttgaataaagagatagcccttcagaaggagtccttaatgagcctgcaggcccagctggacaaagctctgcagaaggagaagcactatctccagactaccatcaccaaagaagcctatgatgcattatcccggaagtcagccgcctgccaggatgacctgacacaagccctcgagaagctcaatcacgtgacctcagagacaaagagcctgcagcaaagcttgacacagacccaagagaagaaagctcagctggaagaggaaatcattgcttatgaggaaaggatgaaaaagctcaatacggaattaagaaaactgcggggcttccaccaggagagtgagctggaggtgcacgcctttgacaagaagctagaggagatgagctgccaggtgctgcagtggcagaagcaacaccagaatgacctcaagatgctggcagccaaagaggagcagctcagggagttccaggaggagatggccgccttaaaagagaacctccttgaggacgataaggagccctgctgcctgccccagtggtctgtgcccaaagacacctgtaggctctaccgagggaatgatcagattatgaccaacttggagcaatgggcaaaacagcagaaggtcgccaatgagaaactaggaaaccagctccgagagcaggtgaaatacattgccaagctgagtggcgaaaaggacagggaaccaaccagagccagcagccccaacacaacccgtccttcctctccttcccacagccacctccacagtgtaatggtccacttgcagcaggaaaacaagaagctgaagaaggagatagaagagaagaagatgaaagccgagaacacaaggctatgcaccaaagccctaggcccgagcagaacggagtccacacagagggagaaagtgtgcggcaccttgggctggaaggggttgccccaggatatgggtcaaagaatggacctcaccaagtacatcgggatgccccactgcccggaaataggaaaactcaacctaaaactcacatggaatcttaagggatcccaacagccaaaacagtctcaaaaaagaagaacaaagctgaagaacttactgacttcaaaacttactacaaacctacagtaatcaaaatagtgtggtactgccatataaatcaaaagacagacatacaaaccaatggaatagactagaaagaatcccagaaataaaccctcacatatatggtcaaataattttgacaacgatgccaagactatgaaatggggaaaggatagtttttgttttagttttccaacaaatggtgctgggaaaactgaatatttgcatgcaaaagaataaagctgtgcccttacctaataccttatacaaaaattaactcaaaatggatcaaagacctaaatgtagccactgaaactataaaactcatagaagaaaacatggaacaaacccttcatggcactggatttggcagtgattagttcaccaaaggcacaggcacgaaaagaaataatagacaaattagacatcctgaaacttttaaacttttgtgcatcaaaagcaacatcaacagagtaaaaaggcaacccacagaataggagaaaatatttccaaatcatatctctgatgttaatatccagaatatatagagaactcctaaaactcaagaaaacaaacaacccagttcaaaaatgggcagag

SEQ ID NO: 1746 - DNA, 1052 bp, Artificial Sequence; identical to SEQ ID NO: 247
  Synthetic polypeptide

SEQ ID NO: 1747 - DNA, 327 bp, Artificial Sequence; identical to SEQ ID NO: 246
  Synthetic polypeptide

SEQ ID NO: 1748 - DNA, 506 bp, Artificial Sequence; identical to SEQ ID NO: 1096
  Synthetic polypeptide

SEQ ID NO: 1749 - DNA, 3934 bp, Artificial Sequence; identical to SEQ ID NO: 1150
  Synthetic polypeptide

SEQ ID NO: 1750 - DNA, 3787 bp, Artificial Sequence; identical to SEQ ID NO: 1151
  Synthetic polypeptide

SEQ ID NO: 1751 - DNA, 867 bp, Artificial Sequence; identical to SEQ ID NO: 1152
  Synthetic polypeptide

SEQ ID NO: 1752 - DNA, 996 bp, Artificial Sequence; identical to SEQ ID NO: 1153
  Synthetic polypeptide

SEQ ID NO: 1753 - DNA, 573 bp, Artificial Sequence; identical to SEQ ID NO: 1369
  Synthetic polypeptide

SEQ ID NO: 1754 - DNA, 416 bp, Artificial Sequence; identical to SEQ ID NO: 1370
  Synthetic polypeptide

SEQ ID NO: 1755 - DNA, 128 bp, Artificial Sequence; identical to SEQ ID NO: 144
  Synthetic polypeptide

SEQ ID NO: 1756 - DNA, 1372 bp, Artificial Sequence
  Synthetic polypeptide
atgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagtaaaaatacaattagctgggcgtggtggcgggtgcctgtaatccagctactccggaggctgaggcaggagaatcgcttgaacctgggagacagaggttatggtgagtcgagattgcaacattgcactccatcctgggggcaacaagagtgaaactccatctcaaaaaaaaaagaaaaaaaaaaaaaga

SEQ ID NO: 1757 - DNA, 2501 bp, Artificial Sequence; identical to SEQ ID NO: 1164
  Synthetic polypeptide

SEQ ID NO: 1758 - DNA, 2552 bp, Artificial Sequence; identical to SEQ ID NO: 1165
  Synthetic polypeptide

SEQ ID NO: 1759 - DNA, 2456 bp, Artificial Sequence; identical to SEQ ID NO: 1166
  Synthetic polypeptide

SEQ ID NO: 1760 - DNA, 588 bp, Artificial Sequence; identical to SEQ ID NO: 1167
  Synthetic polypeptide

SEQ ID NO: 1761 - DNA, 1730 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1762 - DNA, 1733 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1763 - DNA, 1834 bp, Artificial Sequence; identical to SEQ ID NO: 133
  Synthetic polypeptide

SEQ ID NO: 1764 - DNA, 1765 bp, Artificial Sequence; identical to SEQ ID NO: 135
  Synthetic polypeptide

SEQ ID NO: 1765 - DNA, 92 bp, Artificial Sequence
  Synthetic polypeptide
atggacgggcgccgcgtccctgcacagcccgccgcagagggagctcagtgtctgtttgtccagcttctcagagttgctgtgcagctcggatg

SEQ ID NO: 1766 - DNA, 2567 bp, Artificial Sequence
  Synthetic polypeptide
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcggactcctgagagaaaaggctgattgcgggactgggataaggaaatacaagatgagcggagaccgtcctgtgtcagagagca

SEQ ID NO: 1767 - DNA, 572 bp, Artificial Sequence
  Synthetic polypeptide
gtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcggactcctgagagaaaaggctgattgcgggactgggataaggaaatacaagatgagcggagaccgtcctgtgtcagagagca

SEQ ID NO: 1768 - DNA, 569 bp, Artificial Sequence
  Synthetic polypeptide
atggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 1769 - DNA, 497 bp, Artificial Sequence
  Synthetic polypeptide
atggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaacctaagcaaacccaaatggaccaaatgcaacgctgatggaatctaagtgctcagaccaaggaacggggactgaaataacagtggacaccacatggcatgatccaatcagattgagccctggaaagatcatcccatggcaagatccagttagattacacttcctggcatcacctcattgcaagatccaagatcatgcctcattaccttctgcctgtaaaacctgccccagcccccagctccaggagacagatttgagccaggctcctgtctttctctgcagccttgcaataaacttttctttctacaaaaacccagtgctttggtgtttgga

SEQ ID NO: 1770 - DNA, 1718 bp, Artificial Sequence
  Synthetic polypeptide
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggtctgactcaaccttccagatctcagcctaacatcacctcctcagagaagccctccatcactgcccagatgccatccagcgccccatttcatcttctccttgtgtcttgcccttctgcatagcatttatcacaattatcattttttaagtgttatggagtaattgggtatttactacctctacattgagctagaaagtaagttccttgagggtgaagatcttgccatgatctctgctgtgtccccagcgcctggcacacagtaggtactcaagagctgtttgttggatga

SEQ ID NO: 1771 - DNA, 1700 bp, Artificial Sequence
  Synthetic polypeptide
atgtgggttccagtcctagccctgcctgtgtgcacttatgcagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggtctgactcaaccttccagatctcagcctaacatcacctcctcagagaagccctccatcactgcccagatgccatccagcgccccatttcatcttctccttgtgtcttgcccttctgcatagcatttatcacaattatcattttttaagtgttatggagtaattgggtatttactacctctacattgagctagaaagtaagttccttgagggtgaagatcttgccatgatctctgctgtgtccccagcgcctggcacacagtaggtactcaagagctgtttgttggatga

SEQ ID NO: 1772 - DNA, 366 bp, Artificial Sequence
  Synthetic polypeptide
atggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagccactgtatggttgggcaggttgtgtactgcacaaggatttccagccaagcaggcaagtaataggtgaaactgtctgtgccctgctcatcaagcacatatcctggtg

SEQ ID NO: 1773 - DNA, 5505 bp, Artificial Sequence; identical to SEQ ID NO: 1545
  Synthetic polypeptide

SEQ ID NO: 1774 - DNA, 5418 bp, Artificial Sequence; identical to SEQ ID NO: 1546
  Synthetic polypeptide

SEQ ID NO: 1775 - DNA, 2138 bp, Artificial Sequence
  Synthetic polypeptide
atgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgaacctgaacctataatcttgaggagacatcaatcaaacccaaattgagggacattcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctg

SEQ ID NO: 1776 - DNA, 688 bp, Artificial Sequence
  Synthetic polypeptide
tttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgaacctgaacctataatcttgaggagacatcaatcaaacccaaattgagggacattcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctg

SEQ ID NO: 1777 - DNA, 625 bp, Artificial Sequence
  Synthetic polypeptide
atgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgaacctgaacctataatcttgaggagacatcaatcaaacccaaattgagggacattcttcaaaagaaatggtctgtatgcttcaaaaatatcaactcatggaagacaagactgaggaagtgttccagatttaaggggactaacgagataactaaatgtaatgtgtgatcctggattagatcctggacctgagggctttttccccctttgattgtaaaggacagcagtagacaataggtgaaagttgaagaaggtttgttgattagataatagcattgtatcctgattttgatcattgtactctggctatataagagaatgttctttattttacaaaatagtcactggatggagttgaggggaagggacattatctctg

SEQ ID NO: 1778 - DNA, 77 bp, Artificial Sequence
  Synthetic polypeptide
atgccgccgaagttcgaccccaacgagatcaaagtcgcttcttcacgtgtaggtggggagggaggactggaccacct

SEQ ID NO: 1779 - DNA, 586 bp, Artificial Sequence; identical to SEQ ID NO: 401
  Synthetic polypeptide

SEQ ID NO: 1780 - DNA, 829 bp, Artificial Sequence; identical to SEQ ID NO: 402
  Synthetic polypeptide

SEQ ID NO: 1781 - DNA, 1060 bp, Artificial Sequence; identical to SEQ ID NO: 403
  Synthetic polypeptide

SEQ ID NO: 1782 - DNA, 730 bp, Artificial Sequence; identical to SEQ ID NO: 406
  Synthetic polypeptide

SEQ ID NO: 1783 - DNA, 496 bp, Artificial Sequence; identical to SEQ ID NO: 408
  Synthetic polypeptide

SEQ ID NO: 1784 - DNA, 1068 bp, Artificial Sequence; identical to SEQ ID NO: 1221
  Synthetic polypeptide

SEQ ID NO: 1785 - DNA, 1199 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1786 - DNA, 901 bp, Artificial Sequence
  Synthetic polypeptide
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttca

SEQ ID NO: 1787 - DNA, 1015 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccatggaggatgaggagg

SEQ ID NO: 1788 - DNA, 1018 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccatggaggatgaggagg

SEQ ID NO: 1789 - DNA, 465 bp, Artificial Sequence
  Synthetic polypeptide
taatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctcagagccacccaaacccttcatcaccagcaacaactccaaccccatggaggatgaggagg

SEQ ID NO: 1790 - DNA, 1032 bp, Artificial Sequence
  Synthetic polypeptide
atggcggcgcacaggaagcacgatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1791 - DNA, 289 bp, Artificial Sequence
  Synthetic polypeptide
ttttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1792 - DNA, 1314 bp, Artificial Sequence
  Synthetic polypeptide
atggcggcgcacaggaagcacgtgtttgtggagaaggtgctgcagagactttttcctcctgttccaagtggccaaggaaagagggaaccccagacgctggccgtccaaaatccaccaaagaaagtgacctctgagaaagtgagccagaaacatgctgagcctttgacagacactggctctgagaccccgactgcccgacggctctacactgccagcgggcctcctgagggctacgtcccctgttggccggagcccagcagctgtgggagccccgagaacgcctccagcggggatgacacagaagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1793 - DNA, 620 bp, Artificial Sequence
  Synthetic polypeptide
aagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggaggacggtgcggacgccagcgaggaagacccgacatgggctggggaggaagagggtgcagactccggggaggaggacggtgcagacgccagcgaggaagatgatacaattaccaatgaaaaggcacacagtattctaaattttttgaagtcaacacaggaaatgtatttttatgacgcttggggcagaccaacagtcatgccaggagtaaccagaaagccaggatgggaaacacctgttgaagggatcaggaagctactcaggaaaacagctcatagaaagatggaactcctggaaccctcacggggagattatcatggaaacatctgcagccacttgtcttcaggaatctgcaagtcctgtgtgtgggcgttgggtgagggtctggggaaaggacctggtggagcccagagaggcagaaaaaccagc

SEQ ID NO: 1794 - DNA, 2437 bp, Artificial Sequence
  Synthetic polypeptide
atgctgtcccttcagtaccccgacgtgtaccgcgacgagaccgccgtacaggattatcatggtcataaaatttgtgacccttacgcctggcttgaagaccccgacagtgaacagactaaggcctttgtggaggcccagaataagattactgtgccatttcttgagcagtgtcccatcagaggtttatacaaagagagaatgactgaactatatgattatcccaagtatagttgccacttcaagaaaggaaaacggtatttttatttttacaatacaggtttgcagaaccagcgagtattatatgtacaggattccttagagggtgaggccagagtgttcctggaccccaacatactgtctgacgatggcacagtggcactccgaggttatgcgttcagcgaagatggtgaatattttgcctatggtctgagtgccagtggctcagactgggtgacaatcaagttcatgaaagttgatggtgccaaagagcttccagatgtgcttgaaagagtcaagttcagctgtatggcctggacccatgatgggaagggaatgttctacaactcataccctcaacaggatggaaaaagtgatggcacagagacatctaccaatctccaccaaaagctctactaccatgtcttgggaaccgatcagtcagaagatattttgtgtgctgagtttcctgatgaacctaaatggatgggtggagctgagttatctgatgatggccgctatgtcttgttatcaataagggaaggatgtgatccagtaaaccgactctggtactgtgacctacagcaggaatccagtggcatcgcgggaatcctgaagtgggtaaaactgattgacaactttgaaggggaatatgactacgtgaccaatgaggggacggtgttcacattcaagacgaatcgccagtctcccaactatcgcgtgatcaacattgacttcagggatcctgaagagtctaagtggaaagtacttgttcctgagcatgagaaagatgtcttagaatggatagcttgtgtcaggtccaacttcttggtcttatgctacctccatgacgtcaagaacattctgcagctccatgacctgactactggtgctctccttaagaccttcccgctcgatgtcggcagcattgtagggtacagcggtcagaagaaggacactgaaatcttctatcagtttacttcctttttatctccaggtatcatttatcactgtgatcttaccaaagaggagctggagccaagagttttccgagaggtgaccgtaaaaggaattgatgcttctgattaccagacagtccagattcctcgttttttaaaaactgaaggtttgaagcaaccttgtgttgaacaagtctgttaccaccattttcccaacagcatgtgctcagttcgtgtctgtcacattttgataattctcacaatgtttcaagctttttcattattacatcacagtgagctttgatgtgacgatcgtcattgttctggggcatcacaaatgcgctcatagaaggtggtgaacttaactgaaaaatgctgtgtgtgttctgactgctccatccgtcagctataccctcatctctctccctctcgtcagaccgccctattccctgagacataacactgttaaaattaggccaaataataaccctacagtggcctccaaatgttcaaatgcaaggaaaacatgcacatctctcactttaaatcaaaagctagaaattattatgcttagtgaggaaggtatgtcaaaagccaaaataagccaaaagctataggtgcctcttgcaccaaacagccaacttgtgaatgcaaaggaaaagttcttgaaagaaataaaaagtgctatgccagtgaacacatgaatggtaagaaagcaaaacagccttattgctgatatggagaaagtttgagtggtctggatagaagatgaaaccagctgcaaccttcccttaagccaaggcctaatccatagcaaagccctaactttcttcagttctgtgaagactaaaagacatgagaaagctgcagaacattagggagctagcagaggttggttcatgaagtttaaggaacgaagccatctgcacaacataaaagttcaaggtgaagcagcaagtgctgatgtagaagctgcagcaagttatcctgaagatctagctaaaataattgatgaaggtggctgtactaaaacattttcaatataggcagaacagccttctgttggaagaagatgtcatctaggactttcatagctaaagagaagtctgcctggcttcaaagttccaaagtttcaaagttccaaagttccaaaggacaggttgattctattaggggctaatgcagctggtgattttaagttgaagctagtgcacatttaccattcttaaaatcctagggcccttaagaattgtgctaaatta

SEQ ID NO: 1795 - DNA, 1224 bp, Artificial Sequence
  Synthetic polypeptide
gtatcatttatcactgtgatcttaccaaagaggagctggagccaagagttttccgagaggtgaccgtaaaaggaattgatgcttctgattaccagacagtccagattcctcgttttttaaaaactgaaggtttgaagcaaccttgtgttgaacaagtctgttaccaccattttcccaacagcatgtgctcagttcgtgtctgtcacattttgataattctcacaatgtttcaagctttttcattattacatcacagtgagctttgatgtgacgatcgtcattgttctggggcatcacaaatgcgctcatagaaggtggtgaacttaactgaaaaatgctgtgtgtgttctgactgctccatccgtcagctataccctcatctctctccctctcgtcagaccgccctattccctgagacataacactgttaaaattaggccaaataataaccctacagtggcctccaaatgttcaaatgcaaggaaaacatgcacatctctcactttaaatcaaaagctagaaattattatgcttagtgaggaaggtatgtcaaaagccaaaataagccaaaagctataggtgcctcttgcaccaaacagccaacttgtgaatgcaaaggaaaagttcttgaaagaaataaaaagtgctatgccagtgaacacatgaatggtaagaaagcaaaacagccttattgctgatatggagaaagtttgagtggtctggatagaagatgaaaccagctgcaaccttcccttaagccaaggcctaatccatagcaaagccctaactttcttcagttctgtgaagactaaaagacatgagaaagctgcagaacattagggagctagcagaggttggttcatgaagtttaaggaacgaagccatctgcacaacataaaagttcaaggtgaagcagcaagtgctgatgtagaagctgcagcaagttatcctgaagatctagctaaaataattgatgaaggtggctgtactaaaacattttcaatataggcagaacagccttctgttggaagaagatgtcatctaggactttcatagctaaagagaagtctgcctggcttcaaagttccaaagtttcaaagttccaaagttccaaaggacaggttgattctattaggggctaatgcagctggtgattttaagttgaagctagtgcacatttaccattcttaaaatcctagggcccttaagaattgtgctaaatta

SEQ ID NO: 1796 - DNA, 392 bp, Artificial Sequence; identical to SEQ ID NO: 410
  Synthetic polypeptide

SEQ ID NO: 1797 - DNA, 411 bp, Artificial Sequence
  Synthetic polypeptide
atgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcagactcatgaaagacc

SEQ ID NO: 1798 - DNA, 411 bp, Artificial Sequence; identical to SEQ ID NO: 1797
  Synthetic polypeptide

SEQ ID NO: 1799 - DNA, 724 bp, Artificial Sequence
  Synthetic polypeptide
atgtgtaaaatggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggaggtcctggaaccgatcctctgtaaatactgaagaatacctg

SEQ ID NO: 1800 - DNA, 814 bp, Artificial Sequence
  Synthetic polypeptide
atggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggaggtcctggaaccgatcctctgtaaatactgaagaatacctg

SEQ ID NO: 1801 - DNA, 263 bp, Artificial Sequence
  Synthetic polypeptide
atggggccgtcctcttgcctccttctcatcctaatcccccttctccagctgatcaacccggggagtactcagtgttccttagactccgttatggataagaagatcaaggatgttctcaacagtctagagtacagtccctctcctataagcaagaagctctcgtgtgctagtgtcaaaagccaaggcagaccgtcctcctgccctgctggtattctctgtcatagccaccctcccaccttgaggccttcctacgtcctgtctcc

SEQ ID NO: 1802 - DNA, 2466 bp, Artificial Sequence; identical to SEQ ID NO: 1682
  Synthetic polypeptide

SEQ ID NO: 1803 - DNA, 1806 bp, Artificial Sequence; identical to SEQ ID NO: 1683
  Synthetic polypeptide

SEQ ID NO: 1804 - DNA, 2412 bp, Artificial Sequence; identical to SEQ ID NO: 1684
  Synthetic polypeptide

SEQ ID NO: 1805 - DNA, 2211 bp, Artificial Sequence; identical to SEQ ID NO: 1685
  Synthetic polypeptide

SEQ ID NO: 1806 - DNA, 364 bp, Artificial Sequence; identical to SEQ ID NO: 1686
  Synthetic polypeptide

SEQ ID NO: 1807 - DNA, 1117 bp, Artificial Sequence
  Synthetic polypeptide
atggttagtaatttcttccatgtcatacaagtattcgagaaatctgctaccttgattagtaagactgaacacattggttttgtcatttattcatggaggaagtccaccacccacttggggagcagaaggaaatttgccatctcaatttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggccccatcaccagagtggcagagcagcagagcagcggaatagcagagtgacagagaaagaaagaaaagaagaagcagccggatgtcagagagaagcagtttgagctcagagggacagcttgatggtgggacctcggagaagagtttgtctgaactccaggggaataccaccttcccattccatccactttccagctccctatcccgctgagagccacttccatccctcaataaaatcctccacattcactacccttcaatttgtttgcatgacctgattcttcctggacgctaaacaagaactgaggtaccaagaaggcaggtccaaaaggctgtcaccctgaccctccactgagctgttaaatacttgtcatctgtggatagaaaagctaaaagagcacactgtaacactcaccctctggggcttgaggggtcatgggaactcccctagatgttgccatggggcagcacagagttctactcctgctggcacacagaagccctcatcctgatccctacacccactcacctgtgagtttcccctcccatgaggggttgagagctgtgggctgagtaaacaagccaacccctttgcaactcctgcaaagaggccagggaagtaccccatttca

SEQ ID NO: 1808 - DNA, 649 bp, Artificial Sequence
  Synthetic polypeptide
caagacattactgctatggccccatcaccagagtggcagagcagcagagcagcggaatagcagagtgacagagaaagaaagaaaagaagaagcagccggatgtcagagagaagcagtttgagctcagagggacagcttgatggtgggacctcggagaagagtttgtctgaactccaggggaataccaccttcccattccatccactttccagctccctatcccgctgagagccacttccatccctcaataaaatcctccacattcactacccttcaatttgtttgcatgacctgattcttcctggacgctaaacaagaactgaggtaccaagaaggcaggtccaaaaggctgtcaccctgaccctccactgagctgttaaatacttgtcatctgtggatagaaaagctaaaagagcacactgtaacactcaccctctggggcttgaggggtcatgggaactcccctagatgttgccatggggcagcacagagttctactcctgctggcacacagaagccctcatcctgatccctacacccactcacctgtgagtttcccctcccatgaggggttgagagctgtgggctgagtaaacaagccaacccctttgcaactcctgcaaagaggccagggaagtaccccatttca

SEQ ID NO: 1809 - DNA, 972 bp, Artificial Sequence
  Synthetic polypeptide
tttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtttccacttcagagatctgtttctttcaacttttctactgtccataaatcatgtcctgccaaagactggaaggtgcataagggaaaatgttactggattgctgaaactaagaaatcttggaacaaaagtcaaaatgactgtgccataaacaattcatatctcatggtgattcaagacattactgctatggccccatcaccagagtggcagagcagcagagcagcggaatagcagagtgacagagaaagaaagaaaagaagaagcagccggatgtcagagagaagcagtttgagctcagagggacagcttgatggtgggacctcggagaagagtttgtctgaactccaggggaataccaccttcccattccatccactttccagctccctatcccgctgagagccacttccatccctcaataaaatcctccacattcactacccttcaatttgtttgcatgacctgattcttcctggacgctaaacaagaactgaggtaccaagaaggcaggtccaaaaggctgtcaccctgaccctccactgagctgttaaatacttgtcatctgtggatagaaaagctaaaagagcacactgtaacactcaccctctggggcttgaggggtcatgggaactcccctagatgttgccatggggcagcacagagttctactcctgctggcacacagaagccctcatcctgatccctacacccactcacctgtgagtttcccctcccatgaggggttgagagctgtgggctgagtaaacaagccaacccctttgcaactcctgcaaagaggccagggaagtaccccatttca

SEQ ID NO: 1810 - DNA, 1221 bp, Artificial Sequence; identical to SEQ ID NO: 122
  Synthetic polypeptide

SEQ ID NO: 1811 - DNA, 1420 bp, Artificial Sequence; identical to SEQ ID NO: 924
  Synthetic polypeptide

SEQ ID NO: 1812 - DNA, 1336 bp, Artificial Sequence; identical to SEQ ID NO: 925
  Synthetic polypeptide

SEQ ID NO: 1813 - DNA, 1069 bp, Artificial Sequence; identical to SEQ ID NO: 926
  Synthetic polypeptide

SEQ ID NO: 1814 - DNA, 1345 bp, Artificial Sequence; identical to SEQ ID NO: 927
  Synthetic polypeptide

SEQ ID NO: 1815 - DNA, 316 bp, Artificial Sequence
  Synthetic polypeptide
atgcctggtccgacccccagtggcactaacgtgggatcctcagggcgctctcccagcaaagcagtggccgcccgggcggcgggatccactgtccggcagagggaggaaaaaatcttgaacacatgcatggaaacttctgaaggatgtgaagagggatgtgacattttctggctgcaacaggtaaatctaaaactgatgatttgaacttacatgaaatatttcacatcagaacaaagacattctaatagaactggcagaaatgtaaaattatcctgaatgattttgagttccctgtcattgggatgttcatgaggag

SEQ ID NO: 1816 - DNA, 528 bp, Artificial Sequence; identical to SEQ ID NO: 1280
  Synthetic polypeptide

SEQ ID NO: 1817 - DNA, 438 bp, Artificial Sequence; identical to SEQ ID NO: 1281
  Synthetic polypeptide

SEQ ID NO: 1818 - DNA, 1206 bp, Artificial Sequence; identical to SEQ ID NO: 282
  Synthetic polypeptide

SEQ ID NO: 1819 - DNA, 1209 bp, Artificial Sequence; identical to SEQ ID NO: 281
  Synthetic polypeptide

SEQ ID NO: 1820 - DNA, 1203 bp, Artificial Sequence; identical to SEQ ID NO: 286
  Synthetic polypeptide

SEQ ID NO: 1821 - DNA, 1146 bp, Artificial Sequence; identical to SEQ ID NO: 988
  Synthetic polypeptide

SEQ ID NO: 1822 - DNA, 1033 bp, Artificial Sequence
  Synthetic polypeptide
atgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacaggtgacaaggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggcca

SEQ ID NO: 1823 - DNA, 1075 bp, Artificial Sequence
  Synthetic polypeptide
atgcagtgccggctcccgcggggcctggctggagccctcctcaccctcctgtgcatggggctcctgtgtctgcggtaccacttgaacctgtccccgcagcgggtacaagggacccccgagctgagccagccgaacccggggccccctaagctacagctacacgatgtcttcattgcagtgaagacgacccgggctttccaccgcttgcgcctggagctgctgcttgacacgtgggtttccaggaccagggaacagacatttgtcttcaccgacagcccagacaaaggcctccaggagagactggggtcccaccttgtggtcaccaactgctccgcggaacacagccacccagctctgtcctgcaagatggctgctgagttcgacaccttcttggccagtgggcttaggtggttctgccatgtggacgatgacaactatgtgaacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcatccggctgcctgatgactgcaccatgggctatatcattgagtgcaagctgggcggccgcctgcagcccagccccctctttcactcccacctggagaccctgcagctgctgaggactgcacagctcccagaacaggtcaccctcagctacggtgtctttgaggggaaactcaacgtcattaagctacagggccccttctccccggaggaggacccctccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggcca

SEQ ID NO: 1824 - DNA, 317 bp, Artificial Sequence; identical to SEQ ID NO: 995
  Synthetic polypeptide

SEQ ID NO: 1825 - DNA, 1141 bp, Artificial Sequence
  Synthetic polypeptide
atggcctaccacagcttcctggtggagcccatcagctgccacgcctggaacaaggaccgcacccagattgccatctgccccaacaaccatgaggtgcatatctatgaaaagagcggtgccaaatggaccaaggtgcacgagctcaaggagcacaacgggcaggtgacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtttgcaagcacatcaagaagcccatccgctccaccgtcctcagcctggactggcaccccaacaatgtgctgctggctgccggctcctgtgacttcaagtgtcggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggccgtcgcgactctggcctctgaaacactaccactgctggcgctgaccttcatcacagacaacagcctggtggcagcgggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcagccagatctcggtgctcagcggcggcaaggccaagtgctcgcagttctgcaccactggcatggatggcggcatgagtatctgggatgtgaaggcctgcttcctcatggtctggtgaggaggcaggacagatggacatgtaggggctctcacag

SEQ ID NO: 1826 - DNA, 1031 bp, Artificial Sequence
  Synthetic polypeptide
atgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgctctgcctcctctccgaccacgtggacaagaggatcctggatgctgcaggggccaatctcaaagtcatcagcaccatgtctgtgggcatcgaccacttggctttggatgaaatcaagaagcgtgggatccgagttggctacaccccagatgtcctgacagataccaccgccgaactcgcagtctccctgctacttaccacctgccgccggttgccggaggccatcgaggaagtgaagaatggtggctggacctcgtggaagcccctctggctgtgtggctatggactcacgcagagcactgtcggcatcatcgggctggggcgcataggccaggccattgctcggcgtctgaaaccattcggtgtccagagatttctgtacacagggcgccagcccaggcctgaggaagcagcagaattccaggcagagtttgtgtctacccctgagctggctgcccaatctgatttcatcgtcgtggcctgctccttaacacctgcaaccgagggactctgcaacaaggacttcttccagaagatgaaggaaacagctgtgttcatcaacatcagcaggggcgacgtcgtaaaccaggacgacctgtaccaggccttggccagtggtaagattgcagctgctggactggatgtgacgagcccagaaccactgcctacaaaccaccctctcctgaccctgaagaactgtgccaggtatggtggtgcatgcctatagtcccagctgtttgggaggctgaggcagaagaatcgcttgaacccaggaggcacaggttgcagtaggccgagattgtgccactgcactccagcctgggtggcagagtgagactccatctccaaaacaacaacaacaacaaa

SEQ ID NO: 1827 - DNA, 2409 bp, Artificial Sequence; identical to SEQ ID NO: 1481
  Synthetic polypeptide

SEQ ID NO: 1828 - DNA, 1083 bp, Artificial Sequence
  Synthetic polypeptide
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggaggggttctttgctccgtctctactgtttcaaatactgcccaacctcaaagcccagctccaaagctacctcctctgtgaagaactccttg

SEQ ID NO: 1829 - DNA, 495 bp, Artificial Sequence
  Synthetic polypeptide
atgcataatctgtattccatcactgggtacccggacccaccagggaccatggaggaggaggaggaggatgatgactatgagaactcaacacctccctacaaggaccttcctcccaagccagggaccatggaggaggaggaggaggatgatgactatgagaactcaacacctccctacaaggaccttcctcccaagccagatgcccagtcatccctttggagaggctcacatggcaaggaactgaggcctcccaccaacagccatgtgagtgcatcatcttggaagcagatcctctagccccagtcaagcctgcagatgacttgcagtcccaggcaacatcttgactacaatcacgcaagagatctcaagctagaactacccagctaagctgctctcagattcctgaaccacagaaactgtgagataataaatgcttatggttgttttaagtcactgcgttttggggtaattggttgtgcagccatagataactga

SEQ ID NO: 1830 - DNA, 909 bp, Artificial Sequence
  Synthetic polypeptide
ctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtatctttgcttatcttgcccagtacccgatgccacgtggaaatggagtggctcttaattaaggtaagaacatgtgttaggcctctttaccttcatgttaaaataacaattctgatttctaaagcatatgaatcgttactatggagaattagcaatccacaaccctgtgcaattaacttttatccaacttctataaaaatcctggctaagacatagtgatatttaaagaaaagagtctacagacatgctatccattctagatatttggagttctatccccagatctaattagagcaccagaagcctac

SEQ ID NO: 1831 - DNA, 963 bp, Artificial Sequence
  Synthetic polypeptide
atggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtatctttgcttatcttgcccagtacccgatgccacgtggaaatggagtggctcttaattaaggtaagaacatgtgttaggcctctttaccttcatgttaaaataacaattctgatttctaaagcatatgaatcgttactatggagaattagcaatccacaaccctgtgcaattaacttttatccaacttctataaaaatcctggctaagacatagtgatatttaaagaaaagagtctacagacatgctatccattctagatatttggagttctatccccagatctaattagagcaccagaagcctac

SEQ ID NO: 1832 - DNA, 876 bp, Artificial Sequence
  Synthetic polypeptide
atggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtatctttgcttatcttgcccagtacccgatgccacgtggaaatggagtggctcttaattaaggtaagaacatgtgttaggcctctttaccttcatgttaaaataacaattctgatttctaaagcatatgaatcgttactatggagaattagcaatccacaaccctgtgcaattaacttttatccaacttctataaaaatcctggctaagacatagtgatatttaaagaaaagagtctacagacatgctatccattctagatatttggagttctatccccagatctaattagagcaccagaagcctac

SEQ ID NO: 1833 - DNA, 417 bp, Artificial Sequence
  Synthetic polypeptide
atgcataatctgtattccatcactgggtacccggacccaccagggaccatggaggaggaggaggaggatgatgactatgagaactcaacacctccctacaaggaccttcctcccaagccagatgcccagtcatccctttggagaggctcacatggcaaggaactgaggcctcccaccaacagccatgtgagtgcatcatcttggaagcagatcctctagccccagtcaagcctgcagatgacttgcagtcccaggcaacatcttgactacaatcacgcaagagatctcaagctagaactacccagctaagctgctctcagattcctgaaccacagaaactgtgagataataaatgcttatggttgttttaagtcactgcgttttggggtaattggttgtgcagccatagataactga

SEQ ID NO: 1834 - DNA, 417 bp, Artificial Sequence; identical to SEQ ID NO: 1833
  Synthetic polypeptide

SEQ ID NO: 1835 - DNA, 432 bp, Artificial Sequence
  Synthetic polypeptide
atgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggaatttctccaaggaaatcactgaacagagacaaaacccagtgtgcatcacgatgttcatctcagcattatttttaatagtgacaatttgatagcaaccaagatgtccagcattagaagaccactttaagtaaattgtggataatcaatttgatgatgcagtcattaaaaattatgttgactatgtagatgtgacaaagttatgacagaaagcaaaatacaaattgtatgtgtactatgattgaaattttgtaaaaataagtat

SEQ ID NO: 1836 - DNA, 280 bp, Artificial Sequence
  Synthetic polypeptide
atggccaccatggtaccatccgtgttgtggcccagggcctgctggactctgctggtctgctgtctgctgaccccaggatcacctgtccctttcacttgctaactcctacttagccttcagtttcgggctgcaatggtccccgcttccaggaagccttccctgactcacctcctcctatgctggatcagagcctcttctggcctccttctgagttctccccggtctctgatggattctacctttcccactggaccatgaaggcaggaacccttctgtctcg

SEQ ID NO: 1837 - DNA, 1102 bp, Artificial Sequence
  Synthetic polypeptide
atggctttggtcacggtccagcggtcacctacccccagcaccacctccagcccctgcgcctcggaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaattagtaaattatggtacatctatatcattaaatattatgcaaccattaaaaatgatccagttgaaaaatatttgacatggaaagatgttgatgataggctgtaaagcaaaagagcaagttatagatgatatggagaatatggtcatatctttgtttattatacatctatgcatagccaaaaagactggaaagatctacgctaaaatcttaacagtggttatttcagggtggtaggattacaagatatttctgccttttctgtgaggtccctaattttctaaagtaggcatggatcacttttgctatgagggaaacaaa

SEQ ID NO: 1838 - DNA, 1183 bp, Artificial Sequence
  Synthetic polypeptide
atggctttggtcacggtccagcggtcacctacccccagcaccacctccagcccctgcgcctcgagctctcatttggaagacagtgaatcagcagcattactttgctgtgaatgtgaagaatcagaaatctttactgattccaatgaggcagacagtggggaggaagaatgccggtcacagcccaggagcatcagcgagagctttctaactgtcaaaggtgctgccctttttctaccacggggaaatggctcatccacaccaagaatcagccacagacggaacaagcatgcaggcgatctccaacagcatctccaagcaatgttcattttactccgcccagaagacaacatcaggctggctgtaagactggaaagtacttaccagaatcgaacacgctatatggtagtggtttcaactaatggtagacaagacactgaagaaagcatcgtcctaggaatggatttctcctctaatgacagtagcacttgtaccatgggcttagttttgcctctctggagcgacacgctaattcatttggatggtgatggtgggttcagtgtatcgacggataacagagttcacatattcaaacctgtatctgtgcaggcaatgtgggttgacagggattcaaggaacaaacactgtgatgtactattggtggaagaatgaactggagcagcctttctggagagtgatttgccaatatgccttatcattttgcatgatctttgtcctagtaactctatttctatggatttactctaagtttgtaaacatggatgtgtgcaaagattttagctctaagaatgtttgtcagtgttctaataatagcaaaaaataaaaaacaaatgattgaaaaatagaattagtaaattatggtacatctatatcattaaatattatgcaaccattaaaaatgatccagttgaaaaatatttgacatggaaagatgttgatgataggctgtaaagcaaaagagcaagttatagatgatatggagaatatggtcatatctttgtttattatacatctatgcatagccaaaaagactggaaagatctacgctaaaatcttaacagtggttatttcagggtggtaggattacaagatatttctgccttttctgtgaggtccctaattttctaaagtaggcatggatcacttttgctatgagggaaacaaa

SEQ ID NO: 1839 - DNA, 603 bp, Artificial Sequence; identical to SEQ ID NO: 1012
  Synthetic polypeptide

SEQ ID NO: 1840 - DNA, 1858 bp, Artificial Sequence
  Synthetic polypeptide
atggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagggacacagttgtgcagaaatggagccagctctgggaggtggcgagtgtccctttgcaggtgtgtgagtagaggccatgggacggacaccttggaggggttgcagtttggaggatttggtgattggaagaagggattgggct

SEQ ID NO: 1841 - DNA, 2017 bp, Artificial Sequence
  Synthetic polypeptide
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaaggcctcaggagagcgttaccatgtggagccccacccagaacatctctgcggggcctacccctacgcctacccgcccatgccagccatggtgccacaccatggcttcgaggactggtcccagatccgctacccccctccccccatggccatggagcacccgcccccactccccaactcgcgcctcttccatctgccggaatacacctggcgtctaccctgtggaggggttcgaaatccaaatcagagctcccaagtgatggaccctcccacagccaggcctacagaaccagggacacagttgtgcagaaatggagccagctctgggaggtggcgagtgtccctttgcaggtgtgtgagtagaggccatgggacggacaccttggaggggttgcagtttggaggatttggtgattggaagaagggattgggct

SEQ ID NO: 1842 - DNA, 1825 bp, Artificial Sequence
  Synthetic polypeptide
atggaagggagaggaccgtaccggatctacgaccctgggggcagcgtgccctcaggagaggcatccgcagcttttgagcgcctagtgaaggagaattcccggctgaaggaaaaaatgcaagggataaagatgttaggggagcttttggaagagtcccagatggaagcgaccaggctccggcagaaggcagaggagctagtgaaggacaacgagctgctcccaccaccttctccctccttgggctccttcgaccccctggctgagctcacaggaaaggactcaaatgtcacagcatctcccacagcccctgcatgccccagtgacaagccagcaccagtccagaagcctccatccagtggcacctcctctgaatttgaagtggtcactcctgaggagcagaattcaccagagagcagcagccatgccaatgcgatggcgctgggccccctgccccgtgaggacggcaacctgatgctgcacctgcagcgcctggagaccacgctgagtgtgtgtgccgaggagccggaccacggccagctcttcacccacctgggccgcatggccctggagttcaaccgactggcatccaaggtgcacaagaatgagcagcgcacctccattctgcagaccctgtgtgagcagcttcggaaggagaacgaggctctgaaggccaagttggataagggcctggaacagcgggatcaggctgccgagaggctgcgggaggaaaatttggagctcaagaagttgttgatgagcaatggcaacaaagagggtgcgtctgggcggccaggctcaccgaagatggaagggacaggcaagaaggcagtggctggacagcagcaggctagtgtgacggcaggtaaggtcccagaggtggtggccttgggcgcagccgagaagaaggtgaagatgctggagcagcagcgcagtgagctgctggaagtgaacaagcagtgggaccagcatttccggtccatgaagcagcagtatgagcagaagatcactgagctgcgtcagaagctggctgatttgcagaagcaggtgactgacctggaggccgagcgggagcagaagcagcgtgactttgaccgcaagctcctcctggccaagtccaagattgaaatggaggagaccgacaaggagcagctgacagcagaggccaaggagctgcgccaaaaggtcaagtacctgcaggatcagctgagcccactcacccgacagcgtgagtaccaggaaaaggagatccagcggctcaacaaggccctggaggaagcactgagcatccaaaccccgccatcatctccaccaacagcatttgggagcccagaaggagcaggggccctcctaaggaaacaggagctggtcacgcagaatgagttgctgaaacagcaggtgaagatcttcgaggaggacttccagagggagcgcagtgatcgtgagcgcatgaatgaggagaaggaagagctgaagaagcaagtggagaagctgcaggcccaggtcaccctgtcaaatgcccagctaaaagcattcaaagatgaggagaaggcaagagaagccctcagacagcagaagaggaaagcaaagccggaatacacctggcgtctaccctgtggaggggttcgaaatccaaatcagagctcccaagtgatggaccctcccacagccaggcctacagaaccagggacacagttgtgcagaaatggagccagctctgggaggtggcgagtgtccctttgcaggtgtgtgagtagaggccatgggacggacaccttggaggggttgcagtttggaggatttggtgattggaagaagggattgggct

SEQ ID NO: 1843 - DNA, 2557 bp, Artificial Sequence; identical to SEQ ID NO: 1524
  Synthetic polypeptide

SEQ ID NO: 1844 - DNA, 2428 bp, Artificial Sequence; identical to SEQ ID NO: 1525
  Synthetic polypeptide

SEQ ID NO: 1845 - DNA, 669 bp, Artificial Sequence
  Synthetic polypeptide
atgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagctatctatctatctc

SEQ ID NO: 1846 - DNA, 742 bp, Artificial Sequence
  Synthetic polypeptide
atggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattaga

SEQ ID NO: 1847 - DNA, 811 bp, Artificial Sequence
  Synthetic polypeptide
atgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattaga

SEQ ID NO: 1848 - DNA, 679 bp, Artificial Sequence
  Synthetic polypeptide
atgctgcgggcgggagcaccaaccggggacttaccccgggcgggagaagtccacaccgggaccaccatcatggcagtggagtttgacgggggcgttgtgatgggttctgattcccgagtgtctgcagggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattaga

SEQ ID NO: 1849 - DNA, 1204 bp, Artificial Sequence
  Synthetic polypeptide
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1850 - DNA, 1213 bp, Artificial Sequence
  Synthetic polypeptide
atggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaaggtgaaagagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1851 - DNA, 650 bp, Artificial Sequence
  Synthetic polypeptide
gggaagcccagtggaggacaatgagaaggatctggtgaaactggctaaacgcctcaagaaggagaaagtaaatgttgacattatcaattttggggaagaggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1852 - DNA, 324 bp, Artificial Sequence
  Synthetic polypeptide
acattgatgccagctcagctatggacacatctgagccagccaagagctcaattaacagagttctcagcaggcccctctatttggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagaatgtgtgtttcatgacagggcttcttgtctgctttgttcattgctacatctccagtacctgaaatagtacct

SEQ ID NO: 1853 - DNA, 1081 bp, Artificial Sequence; identical to SEQ ID NO: 986
  Synthetic polypeptide

SEQ ID NO: 1854 - DNA, 1054 bp, Artificial Sequence; identical to SEQ ID NO: 987
  Synthetic polypeptide

SEQ ID NO: 1855 - DNA, 348 bp, Artificial Sequence
  Synthetic polypeptide
atgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaagcctggataacagtaaaaacaggacccaagaagatgaaagagccagacatggaaaatttctggatcctcaaatcactccatagaggaaagctgcccactcacaagaaataaccacctttgtctgttatgtgaccaagaaataaatgtctcttatatt

SEQ ID NO: 1856 - DNA, 1022 bp, Artificial Sequence
  Synthetic polypeptide
gggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccaggctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcaggtttcctgtctgtgcgatggggatggaggtgatagtgtctaccctcctgaggtcgttggggggactaaatgggatagtaagtgtaaatgggacagcagtgccaggcacagagtgagcacttcaataagt

SEQ ID NO: 1857 - DNA, 619 bp, Artificial Sequence
  Synthetic polypeptide
atgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcaggtttcctgtctgtgcgatggggatggaggtgatagtgtctaccctcctgaggtcgttggggggactaaatgggatagtaagtgtaaatgggacagcagtgccaggcacagagtgagcacttcaataagt

SEQ ID NO: 1858 - DNA, 346 bp, Artificial Sequence
  Synthetic polypeptide
atggcgtcttctatgacctggacagctgcaagcattccagctaccctgattcagagggggctcctgaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcaggtttcctgtctgtgcgatggggatggaggtgatagtgtctaccctcctgaggtcgttggggggactaaatgggatagtaagtgtaaatgggacagcagtgccaggcacagagtgagcacttcaataagt

SEQ ID NO: 1859 - DNA, 757 bp, Artificial Sequence
  Synthetic polypeptide
atgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagctcaggatttggcacacagaagctcaatgtgtatttgttgaat

SEQ ID NO: 1860 - DNA, 817 bp, Artificial Sequence
  Synthetic polypeptide
atgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagctcaggatttggcacacagaagctcaatgtgtatttgttgaat

SEQ ID NO: 1861 - DNA, 767 bp, Artificial Sequence; identical to SEQ ID NO: 937
  Synthetic polypeptide

SEQ ID NO: 1862 - DNA, 677 bp, Artificial Sequence; identical to SEQ ID NO: 938
  Synthetic polypeptide

SEQ ID NO: 1863 - DNA, 464 bp, Artificial Sequence
  Synthetic polypeptide
atgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgaacctgggtcgtgtgtaacatgcatgtttgttccctagcctgcatcaggaccaccttcatgaatatccatagctcctgttgaatatgtatgtttagctaactcattcatcatatatcttctaccccaatcccttctccttcaaagtgcctgtctttggtgtagccctcccagcttgccagatggccaccttgcaggttgtaaccctttataagaaataaagtctccttttccaaatttatagatcttgtgattttt

SEQ ID NO: 1864 - DNA, 980 bp, Artificial Sequence; identical to SEQ ID NO: 139
  Synthetic polypeptide

SEQ ID NO: 1865 - DNA, 1256 bp, Artificial Sequence; identical to SEQ ID NO: 140
  Synthetic polypeptide

SEQ ID NO: 1866 - DNA, 1277 bp, Artificial Sequence; identical to SEQ ID NO: 142
  Synthetic polypeptide

SEQ ID NO: 1867 - DNA, 287 bp, Artificial Sequence
  Synthetic polypeptide
atggaggactttgctaccaggacctacggcaccagtggcctggacaacagacctctgtttggggagacgtccgccaaggcttcagttacctgtggtcagccatggtccaaaaatattaaatggaaaacttcagaaataatttgtaagttttaaactgtgcactgttctatgtaatatgattaactctcactctgtcctgctcctgctggggatgtgaatcatccctttgtccagtagatgctacctgcctgttagtcacttagtagccatctctgttatctgattga

SEQ ID NO: 1868 - DNA, 338 bp, Artificial Sequence
  Synthetic polypeptide
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagggcatgacgaagctttgttcatctctgtacctccagctgccagctcaatgcctagcatattgtggacattcaatatatat

SEQ ID NO: 1869 - DNA, 344 bp, Artificial Sequence
  Synthetic polypeptide
atgacagaggggaccaagaagaccagcaaaaagttcagtgcagtggtggctcacgcctgtaatcccagcactttgggaggccgaggctggtggatcacctgaggtcaggagttcgagaccagcctggccaacatggtgaaacccctctctactaaaaatacaaaaaattagctgggtatggtgacacgcacctgtaatcccagctactcaggaggctgaggcagaagaaacgcttgaacccaggaggtggagatagcagtgagcagagattgcaccactgcactccagtctgggcgacacagcgagactgcatctcaaaaaataagtaaataaataaagtaaaa

SEQ ID NO: 1870 - DNA, 617 bp, Artificial Sequence
  Synthetic polypeptide
atgagctggggcaccgagctctgggatcagtttgacaacttagaaaaacacacacagtggggaattgatattcttgagaaatatatcaagtttgtgaaagaaaggacagagattgaactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggtgctgtggcacatacccctagactcagctacttaggagactgaagcaagaggattgcttgagcccaggagtccagactgggcaacataacgagaccccatctc

SEQ ID NO: 1871 - DNA, 502 bp, Artificial Sequence
  Synthetic polypeptide
aactcagctatgcaaagcaactcaggaatctttcaaagaagtaccaacctaaaaagaactcgaaggaggaagaagaatacaagtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcaaactttcacgatggccgtaaagcacagcagcacatcgagacttgctggaagcagcttgaatctagtaaaaggcgatttgaacgcgattgcaaagaggcggacagggcgcagcagtactttgagaaaatggacgctgacatcaatgtcacaaaagcggatgttgaaaaggtgctgtggcacatacccctagactcagctacttaggagactgaagcaagaggattgcttgagcccaggagtccagactgggcaacataacgagaccccatctc

SEQ ID NO: 1872 - DNA, 649 bp, Artificial Sequence
  Synthetic polypeptide
atgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggcccactttgtagccccatcacccttggcctgctggtggctggcgtcctggttctgctggtttccctgggagtggccatccacctgtgctgccggcggaggagagcccggcttcgtttcatgaaacagaaattcaatatcgtttgcctgaaaataa

SEQ ID NO: 1873 - DNA, 559 bp, Artificial Sequence
  Synthetic polypeptide
atgcggccgcggctgtggctcctcttggccgcgcagctgacagttctccatggcaactcagtcctccagcagacccctgcatacataaaggtgcaaaccaacaagatggtgatgctgtcctgcgaggctaaaatctccctcagtaacatgcgcatctactggctgagacagcgccaggcaccgagcagtgacagtcaccacgagttcctggccctctgggattccgcaaaagggactatccacggtgaagaggtggaacaggagaagatagctgtgtttcgggatgcaagccggttcattctcaatctcacaagcgtgaagccggaagacagtggcatctacttctgcatgatcgtcgggagccccgagctgaccttcgggaagggaactcagctgagtgtggttgatttccttcccaccactgcccagcccaccaagaagtccaccctcaagaagagagtgtgccggttacccaggccagagacccagaagggccggcggaggagagcccggcttcgtttcatgaaacagaaattcaatatcgtttgcctgaaaataa

SEQ ID NO: 1874 - DNA, 109 bp, Artificial Sequence
  Synthetic polypeptide
atgcggccgcggctgtggctcctcttggccgcgcagctgacaggccggcggaggagagcccggcttcgtttcatgaaacagaaattcaatatcgtttgcctgaaaataa

SEQ ID NO: 1875 - DNA, 509 bp, Artificial Sequence
  Synthetic polypeptide
atgagtgctgagcttaacgtgcctatcgacccctctgctcctgcctgccctgagcccggccataagggcatggattaccgggactgggtccgccgcagctacctggaactggtcacctctaaccaccactcggtacaggccctgtcgtggcggaagctctacctgagcagggccaagctgaaggcctccagcaggacctccgccctcctctccggctttgccatggcgtgttggctcacacctgtaatcctaacactttgggaggccgaggtgagtggatcacttgagatcaggagttcgagaccagcctggccaacatggtgaaacaccgtctctactaaaagtacaaaaaaattagctgggtatggtagcaggcgcctgtaatcccagctacttgggaggctgagacacaagaatcgcttgaacctgggaggccggaggttgcagtgagccaaggtcacgccactatactccagctggtcaagagtgagactttgtctcgaaataaa

SEQ ID NO: 1876 - DNA, 722 bp, Artificial Sequence; identical to SEQ ID NO: 1598
  Synthetic polypeptide

SEQ ID NO: 1877 - DNA, 866 bp, Artificial Sequence; identical to SEQ ID NO: 1599
  Synthetic polypeptide

SEQ ID NO: 1878 - DNA, 740 bp, Artificial Sequence; identical to SEQ ID NO: 1600
  Synthetic polypeptide

SEQ ID NO: 1879 - DNA, 150 bp, Artificial Sequence
  Synthetic polypeptide
atgcctggtccgacccccagtggcactaacgtgggatcctcagggcgctctcccagcaaagcagtggccgcccgggcggcgggatccactgtccggcagaggtacccaccataaggcatgacacaataaataatgactgaaggaaggaat

SEQ ID NO: 1880 - DNA, 562 bp, Artificial Sequence
  Synthetic polypeptide
caagtcgcctacgtgcgcgcccgggagctgcacactcttgaagtgaccggcctggagacggttgcccagagcaaggcccatgtagcatccctggagggcctcatccctgaagataaggttgtgcttctggcaggttctcccttacagaatgaagccaccctgggtcagtgtggggtggaagccctgacaaccctggaagtggttggccgcaggctaggagatggtgagtttataaaagactgtctattgagtgcagcggaaatcatgtgtcctgaacagaaagaagcatttgcagacataagcctaaccagaaaaactgttgctcagagagtaaaagatatggctgagaatttacaggataagttgtgagaaaaagtgagatcatttgtgacattttctattgcagttgatgagtgcacatatgtaaataatacaagtcagttaattatgtttatccatggtgttgctgagaattttgatatcattgaagaacttttagacatggtacctatggcagatccaaccactgaaagtgacttatttttgtatgttgaaaaaagtc

SEQ ID NO: 1881 - DNA, 207 bp, Artificial Sequence
  Synthetic polypeptide
atggccaccatggtaccatccgtgttgtggcccagggcctgctggactctgctggtctgctgtctgctgaccccaggaagccttccctgactcacctcctcctatgctggatcagagcctcttctggcctccttctgagttctccccggtctctgatggattctacctttcccactggaccatgaaggcaggaacccttctgtctcg

SEQ ID NO: 1882 - DNA, 1310 bp, Artificial Sequence
  Synthetic polypeptide
atggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggactccatgttttcgttggccctgaaatgccttatcagtctgtccaccatcatccttttgggcttgatcatcgcctaccacacacgtgaagtccagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaa

SEQ ID NO: 1883 - DNA, 395 bp, Artificial Sequence
  Synthetic polypeptide
atggagagacctataaaggactccatgttttcgttggccctgaaatgccttatcagtctgtccaccatcatccttttgggcttgatcatcgcctaccacacacgtgaagtccagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaa

SEQ ID NO: 1884 - DNA, 371 bp, Artificial Sequence
  Synthetic polypeptide
atgttttcgttggccctgaaatgccttatcagtctgtccaccatcatccttttgggcttgatcatcgcctaccacacacgtgaagtccagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaa

SEQ ID NO: 1885 - DNA, 161 bp, Artificial Sequence
  Synthetic polypeptide
atgctgctgtgggtgatattactggtcctggctcctgtcagtggacagtttgctgtgatgggattcttctgggcacttgaatcatcatctacaaaatgaagatattaggtaagttgagctctcaaggttttctcagggacaaatcttaagataatatgatt

SEQ ID NO: 1886 - DNA, 177 bp, Artificial Sequence
  Synthetic polypeptide
atggctactcatcacacactgtggatgggactggccctgctgggggtgctgggcgacctgcaggcagcaccggaggcccaggtctccgtgcagcccaacttccagcaggacaagttcctggggcggggcgtgaggggcgtggctgctcgggggattgggcgtgggggcggggccggg

SEQ ID NO: 1887 - DNA, 258 bp, Artificial Sequence
  Synthetic polypeptide
atggctgcaagtggccgaggtctctgcaaggctgtggccgcctctcccttcccggcgtggagacgagataacacggaagccaggggaggtctgaagcctgagtatgatgcggtggtgataggagcaggcaggcacctgggattccggtgctggctctgctgtgtggcctggggcaaatgcttgccttctctgggcttggatcttcccatggagaatgacaggaagactaggtgagctcaggggtttccctatatctct

SEQ ID NO: 1888 - DNA, 906 bp, Artificial Sequence
  Synthetic polypeptide
atggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaagatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacgacagagatgctcaatatttgttgaagcaatgaa

SEQ ID NO: 1889 - DNA, 1077 bp, Artificial Sequence
  Synthetic polypeptide
atggaagagggaaacaacaatgaagaggtaattcacttgaacaactttcactgccatcggggacaagagtggatcaatctccgagatgggcccatcaccatatctgactcctcagatgaggaaaggattccaatgctggtcaccccagctcctcagcagcatgaagaagaggacctggatgatgatgtcatcctgacagaaacaaataaacctcagagatcacgacccaatctcatcaaaccagctgcccagtggcaagatctgaaaaggttgggagaagaaaggcctaaaaagtctagagcagcatttgaatcagataagagcagctatttttcagtgtgtaacaacccattgtttgattctggggcacaggatgattctgaggatgactacggtgaatttctggatcttgggcctcctggaatctctgaattcactaagccaagtggccaaacagaaagagaacccaagcctggaccgagtcataaccaagcagcaaatgacattgtcaaccccagatcagagcagaaagtcatcatcttggaagaaggtagccttctttacacagaaagcgatcctttggaaactcagaaccagtcatccgaagactcagagacagagctgttatcaaatctaggagagtcagctgctctagcagatgatcaggccatcgaagaagactgctggttagatcatccttacttccagtctctgaaccaacagccccgtgaaataacaaaccaggtcgttcctcaggaacggcagcctgaagcagaactgggccgcttgttgtttcagcatgaattcccagggcccgcttttccaaggccggaaccccagcaaggtgggatttcaggcccctcttctcctcagcctgcccatcctctaggagagtttgaagaccagcagttagcaagtgatgatgaagagccaggtccagcctttccaatgcaagaatctcaagagcccaatttggaaaacatttgggggcaagaagctgcagaggtagatcaagagctcgttgaactactagtgaaagaaacgacagagatgctcaatatttgttgaagcaatgaa

SEQ ID NO: 1890 - DNA, 1809 bp, Artificial Sequence
  Synthetic polypeptide
atggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtgacagagcaagaccctgtctcaaaacaaaa

SEQ ID NO: 1891 - DNA, 1812 bp, Artificial Sequence
  Synthetic polypeptide
atggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtgacagagcaagaccctgtctcaaaacaaaa

SEQ ID NO: 1892 - DNA, 1875 bp, Artificial Sequence
  Synthetic polypeptide
atggcagactattcaacagtgcctcccccctcttctggctcagctggtggcggtggtggcggcggtggtggtggaggagttaacgacgctttcaaagatgcactgcagagagcccggcagattgcagcaaaaattggaggtgatgcagggacatcactgaattcaaatgactatggttatgggggacaaaaaagacctttagaagatggagatggctcttggacaagtccgagcagtacaacacactgggagggaatgccctctccttttaaagatcaaccagatgctaagaaagttgctcctcaaaatgactcttttggaacacagttaccaccgatgcatcagcagcaaagcagatctgtaatgacagaagaatacaaagttccagatggaatggttggattcataattggcagaggaggtgaacagatctcacgcatacaacaggaatctggatgcaaaatacagatagctcctgacagtggtggccttccagaaaggtcctgtatgttaactggaacacctgaatctgtccagtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggaacgggctggagttaaaatggttatgattcaagacgggccgcagaacactggtgctgacaaacctcttaggattacaggagacccatataaagttcaacaagccaaggaaatggtgttagagttaattcgtgatcaaggcggtttcagagaagttcggaatgagtatgggtcaagaataggaggaaatgaagggatagatgtccccattccaagatttgctgttggcattgtaataggaagaaatggagagatgatcaaaaaaatacaaaatgatgctggtgttcgcattcagtttaagccagatgatgggacaacacccgaaaggatagcacaaataacaggacctccagaccgatgtcaacatgctgcagaaattattacagaccttcttcgaagtgttcaggctggtaatcctggtggacctggacctggtggtcgaggaagaggtagaggtcaaggcaactggaacatgggaccacctggtggactacaggaatttaattttattgtgccaactgggaaaactggattaataataggaaaaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcatggtcctccagccccatatgctccccagggatggggaaatgcatatccacactggcagcagcaggctcctcctgatccagctaaggcaggaacggatccaaattcagcagcttgggctgcttattacgctcactattatcaacagcaagcacagccaccaccagcagcccctgcaggtgcaccaactacaactcaaactaatggacaaggagatcagcagaatccagccccagctggacaggttgattataccaaggcttgggaagagtactacaagaaaatgggtgacagagcaagaccctgtctcaaaacaaaa

SEQ ID NO: 1893 - DNA, 504 bp, Artificial Sequence
  Synthetic polypeptide
atggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1894 - DNA, 801 bp, Artificial Sequence
  Synthetic polypeptide
atggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1895 - DNA, 438 bp, Artificial Sequence
  Synthetic polypeptide
atgctttccccttgtctctcgtcttattttgtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1896 - DNA, 145 bp, Artificial Sequence
  Synthetic polypeptide
ggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaa

SEQ ID NO: 1897 - DNA, 378 bp, Artificial Sequence
  Synthetic polypeptide
atggcccgggagaggccgcccgggaggggctgcggcgtcctgcgccggtgtctactcggggctgtgctgttgttcggcctgcggctctgcgcagagctgcggcgcgccgggcccgggtagatcttcctggagtcaggttgcttgggaatgcagcccagtgcagttaattggtggtaaactccaattaaagctaaagaccggcacaagaccaatagtcaaccagtgccacaagagaaagttggaaagaactttgaagagagagttcaagagggcgtgaaaccttaagggtaaacaggtgggatctgtgcagccttccagaggattgaactgggcagcgagtctggccctgatgacagtcctgcagatctttcctgctcc

SEQ ID NO: 1898 - DNA, 1230 bp, Artificial Sequence
  Synthetic polypeptide
atgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1899 - DNA, 456 bp, Artificial Sequence
  Synthetic polypeptide
atgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1900 - DNA, 1134 bp, Artificial Sequence
  Synthetic polypeptide
atgaggaggcctggggaccatgggctccaggatcaagaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1901 - DNA, 1140 bp, Artificial Sequence
  Synthetic polypeptide
atgttgaagtggcctatcccaggacaggtggcactctttcaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1902 - DNA, 1134 bp, Artificial Sequence
  Synthetic polypeptide
atgttgaagtggcctatcccaggacaggtggcactctttcagatcctgaggtgcagaggcaattcccggaggactacagtgaccagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggattcctgttgagattaaatcagagtacatgaggaaaggtttgt

SEQ ID NO: 1903 - DNA, 277 bp, Artificial Sequence
  Synthetic polypeptide
atgatgagaatagaggtaaaggtgaaaatgatgctttgatgcctgaaggtacaacaaacatctcatgactatgaggggatgaaaatggataccaaggataccaagatgatggaacaaaaagaattgatttggaacatgacggcactatggattcatcgtattggacctctgtgatataattctgaacttttcatataagactaatatacccctacttgtttaatacaactgtagagttatctgctacttgcagccaaatgtaatcctaactaatata

SEQ ID NO: 1904 - DNA, 1307 bp, Artificial Sequence
  Synthetic polypeptide
atgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1905 - DNA, 1421 bp, Artificial Sequence
  Synthetic polypeptide
atgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1906 - DNA, 1325 bp, Artificial Sequence
  Synthetic polypeptide
atgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1907 - DNA, 1403 bp, Artificial Sequence
  Synthetic polypeptide
atgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1908 - DNA, 539 bp, Artificial Sequence
  Synthetic polypeptide
atggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1909 - DNA, 1262 bp, Artificial Sequence
  Synthetic polypeptide
atgcataggtcctttctacaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagttggctgggcatggtcatgcactcctgtggtcctagctacttcaggaggctgaagtggatcacttgagcccaggaggttgaggctgcagggagctgtgttcgcatcactgcatcccacctggagatagagtaagaccctgtctcaaaaataaaaattaaaaacaacaaa

SEQ ID NO: 1910 - DNA, 1052 bp, Artificial Sequence; identical to SEQ ID NO: 247
  Synthetic polypeptide

SEQ ID NO: 1911 - DNA, 327 bp, Artificial Sequence; identical to SEQ ID NO: 246
  Synthetic polypeptide

SEQ ID NO: 1912 - DNA, 3308 bp, Artificial Sequence; identical to SEQ ID NO: 428
  Synthetic polypeptide

SEQ ID NO: 1913 - DNA, 3203 bp, Artificial Sequence; identical to SEQ ID NO: 429
  Synthetic polypeptide

SEQ ID NO: 1914 - DNA, 2849 bp, Artificial Sequence; identical to SEQ ID NO: 430
  Synthetic polypeptide

SEQ ID NO: 1915 - DNA, 388 bp, Artificial Sequence; identical to SEQ ID NO: 431
  Synthetic polypeptide

SEQ ID NO: 1916 - DNA, 361 bp, Artificial Sequence
  Synthetic polypeptide
atgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagcctagcacaaaactagaagcaacccaagcacctgtcactggagactaattatgcggcacccatacagggaccctctgcggccatcatggagagccttcatcttgcccgtacagttttaagcgaaaaaggaagtatacaacaaagtccatagtatgctatgattcattttgtgtcttaagaaagga

SEQ ID NO: 1917 - DNA, 95 bp, Artificial Sequence
  Synthetic polypeptide
atggcagaggttgcagtgagctgagatcgtgcggctgcactccaccttgggcgacagagcgagactccatctcaagaaaaaagaaagaaagaaaa

SEQ ID NO: 1918 - DNA, 1743 bp, Artificial Sequence; identical to SEQ ID NO: 1253
  Synthetic polypeptide

SEQ ID NO: 1919 - DNA, 1518 bp, Artificial Sequence; identical to SEQ ID NO: 1254
  Synthetic polypeptide

SEQ ID NO: 1920 - DNA, 1767 bp, Artificial Sequence; identical to SEQ ID NO: 1255
  Synthetic polypeptide

SEQ ID NO: 1921 - DNA, 1390 bp, Artificial Sequence
  Synthetic polypeptide
atgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1922 - DNA, 1384 bp, Artificial Sequence
  Synthetic polypeptide
atgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1923 - DNA, 1408 bp, Artificial Sequence
  Synthetic polypeptide
atggggaggggcttcaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1924 - DNA, 496 bp, Artificial Sequence
  Synthetic polypeptide
atgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagagatcattgatggcacttcagaaatgaatgaaggaaagaggtcccagaagacgcctagtacaccacgaagggtcacacaaggtacatggatgaagctggaacccatcatcctcagcaaagtaacacaggaacagaaaaccaaacaccgcatgttctcactcataagtgggagttgatcattgagaacacatggacacagagaggggaacaacacacaccagggcctgttggggtgtgggtggtgaggggagggaacttagaggatgggtcaataggtgcagcaagccaccatggcacatgcatacctatgtaagaaacctgcatgttctgcacgtgtgtccc

SEQ ID NO: 1925 - DNA, 2466 bp, Artificial Sequence; identical to SEQ ID NO: 1682
  Synthetic polypeptide

SEQ ID NO: 1926 - DNA, 1146 bp, Artificial Sequence; identical to SEQ ID NO: 988
  Synthetic polypeptide

SEQ ID NO: 1927 - DNA, 1273 bp, Artificial Sequence
  Synthetic polypeptide
atgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgaggg

SEQ ID NO: 1928 - DNA, 1516 bp, Artificial Sequence
  Synthetic polypeptide
atgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgaggg

SEQ ID NO: 1929 - DNA, 1393 bp, Artificial Sequence
  Synthetic polypeptide
atgtgtgaagtgtcaagggggtggaagccgtgcactgagggaatcctaaaagtaagacctacaagaaaaatcagctatgaagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgaggg

SEQ ID NO: 1930 - DNA, 193 bp, Artificial Sequence; identical to SEQ ID NO: 975
  Synthetic polypeptide

SEQ ID NO: 1931 - DNA, 822 bp, Artificial Sequence; identical to SEQ ID NO: 119
  Synthetic polypeptide

SEQ ID NO: 1932 - DNA, 1673 bp, Artificial Sequence
  Synthetic polypeptide
atgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactctccggcaagacctccaccgaggccgccgccaagacctccaccgaggccaccgccatagccactgccactgcc

SEQ ID NO: 1933 - DNA, 3881 bp, Artificial Sequence; identical to SEQ ID NO: 1162
  Synthetic polypeptide

SEQ ID NO: 1934 - DNA, 3722 bp, Artificial Sequence; identical to SEQ ID NO: 1163
  Synthetic polypeptide

SEQ ID NO: 1935 - DNA, 610 bp, Artificial Sequence; identical to SEQ ID NO: 163
  Synthetic polypeptide

SEQ ID NO: 1936 - DNA, 412 bp, Artificial Sequence; identical to SEQ ID NO: 1704
  Synthetic polypeptide

SEQ ID NO: 1937 - DNA, 840 bp, Artificial Sequence
  Synthetic polypeptide
atgtggccccaaccccgcctccctccccaccccgcgatgtcagaaaaaacacaacaggggaaattggccgcagccaagaaaaagttaaaagcatattggcagaggaagagccctggcattccagcaggagctaacaggaaaaagaaagtcaatggcagtagccctgacacagccacttctggtggttaccactcacctggggattcagcaacaggtatctacggggagggccgtgcatcctctactaccctgcaggatctggagagccagtaccaagaactagcagtagccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggag

SEQ ID NO: 1938 - DNA, 385 bp, Artificial Sequence
  Synthetic polypeptide
atgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagacgattacttgagcccaggaggcagaggttgcagtgagctgagatcttaccactgcattccagcaagactcagtctcaaaaaaaaaaaagaaaaaaaaaaaaagaaa

SEQ ID NO: 1939 - DNA, 840 bp, Artificial Sequence; identical to SEQ ID NO: 1937
  Synthetic polypeptide

SEQ ID NO: 1940 - DNA, 487 bp, Artificial Sequence; identical to SEQ ID NO: 918
  Synthetic polypeptide

SEQ ID NO: 1941 - DNA, 823 bp, Artificial Sequence
  Synthetic polypeptide
atggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1942 - DNA, 715 bp, Artificial Sequence
  Synthetic polypeptide
atggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1943 - DNA, 299 bp, Artificial Sequence
  Synthetic polypeptide
gctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1944 - DNA, 148 bp, Artificial Sequence
  Synthetic polypeptide
aaacttctgtctgacaaactgaaagaggctgaggcaggaggatcgcttgaacccaggaagtggagactgcagtgagccgatatcgcaccacagcgctccagcctggtcgacagagtgagactccatctcaagaaaaaataaaaataaa

SEQ ID NO: 1945 - DNA, 2367 bp, Artificial Sequence
  Synthetic polypeptide
atggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggacttctcagaggctttgataaagtcctgtgcctaacctgcaagaggggcatggggaatgaattcagtgcttcccaagtgaacctgaccacagaacctttacagagcacccggcaggatgagagttccacggcgcaaactttgggaa

SEQ ID NO: 1946 - DNA, 578 bp, Artificial Sequence
  Synthetic polypeptide
atgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1947 - DNA, 488 bp, Artificial Sequence
  Synthetic polypeptide
atgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1948 - DNA, 479 bp, Artificial Sequence
  Synthetic polypeptide
atgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1949 - DNA, 470 bp, Artificial Sequence
  Synthetic polypeptide
atgcagcctgcttctgcaaagtggtacgatcgaagggactatgtcttcattgaattttgtgttgaagacagtaaggatgttaatgtaaattttgaaaaatccaaacttacattcagttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtgcctgtaatcccagctactggtgagctgaggtgggagaatcgcttgaacctgggaggcggaggttgcagtgagccaagatcacaccattgcactccagtgtgggcagcagagcgaggctccatctcaaaaagaaagaa

SEQ ID NO: 1950 - DNA, 1391 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaacggcatgaacccgggaggcagggcttgcagtgagccaagatcatgccgctgcactccagcctgggagacaaagtgagactccgtcaaaaaaaaaaaaaa

SEQ ID NO: 1951 - DNA, 1394 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggagaacggcatgaacccgggaggcagggcttgcagtgagccaagatcatgccgctgcactccagcctgggagacaaagtgagactccgtcaaaaaaaaaaaaaa

SEQ ID NO: 1952 - DNA, 1673 bp, Artificial Sequence
  Synthetic polypeptide
atgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggttagtagcttccactgctacctccggcaagacctccaccgaggccgccgccaagacctccaccgaggccaccgccatagccactgccactgcc

SEQ ID NO: 1953 - DNA, 1398 bp, Artificial Sequence; identical to SEQ ID NO: 948
  Synthetic polypeptide

SEQ ID NO: 1954 - DNA, 1302 bp, Artificial Sequence; identical to SEQ ID NO: 949
  Synthetic polypeptide

SEQ ID NO: 1955 - DNA, 1394 bp, Artificial Sequence; identical to SEQ ID NO: 1118
  Synthetic polypeptide

SEQ ID NO: 1956 - DNA, 1625 bp, Artificial Sequence; identical to SEQ ID NO: 1119
  Synthetic polypeptide

SEQ ID NO: 1957 - DNA, 1505 bp, Artificial Sequence; identical to SEQ ID NO: 1120
  Synthetic polypeptide

SEQ ID NO: 1958 - DNA, 1562 bp, Artificial Sequence; identical to SEQ ID NO: 1121
  Synthetic polypeptide

SEQ ID NO: 1959 - DNA, 1601 bp, Artificial Sequence; identical to SEQ ID NO: 1122
  Synthetic polypeptide

SEQ ID NO: 1960 - DNA, 1631 bp, Artificial Sequence; identical to SEQ ID NO: 1123
  Synthetic polypeptide

SEQ ID NO: 1961 - DNA, 2030 bp, Artificial Sequence
  Synthetic polypeptide
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacattataggttaatcatgcagtgaaaaaaggcacctttgctgtgaagaaatctggtggcctttcccttatccaagtgatcaaagttatcaatagaagcacagacagacatcatgtgcctcccagtgtcctgcactagggaggccacagcatcacctctgtcctgttcttgcccccaccgacccctgaaatggattacctgaatctaaattttgaggaataatcagacaaacccaagttaaggggcatgctacaaaacaacggccagcacatttcaaaaatgtcagtgacagaaaagaaagacctaaggaagagccatgccaacgaaaggccatattggatcctgaatccagaagggtgcaaggttgctataaaggacatttttggaaaatctgacaattcgaatatgcaccatatattcgacaatagaattctatcaaagttttgtttcctaaaattgaaaatcaa

SEQ ID NO: 1962 - DNA, 1847 bp, Artificial Sequence
  Synthetic polypeptide
atgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacattataggttaatcatgcagtgaaaaaaggcacctttgctgtgaagaaatctggtggcctttcccttatccaagtgatcaaagttatcaatagaagcacagacagacatcatgtgcctcccagtgtcctgcactagggaggccacagcatcacctctgtcctgttcttgcccccaccgacccctgaaatggattacctgaatctaaattttgaggaataatcagacaaacccaagttaaggggcatgctacaaaacaacggccagcacatttcaaaaatgtcagtgacagaaaagaaagacctaaggaagagccatgccaacgaaaggccatattggatcctgaatccagaagggtgcaaggttgctataaaggacatttttggaaaatctgacaattcgaatatgcaccatatattcgacaatagaattctatcaaagttttgtttcctaaaattgaaaatcaa

SEQ ID NO: 1963 - DNA, 1395 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaacggcatgaacccgggaggcagggcttgcagtgagccaagatcatgccgctgcactccagcctgggagacaaagtgagactccgtcaaaaaaaaaaaaaa

SEQ ID NO: 1964 - DNA, 1398 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaacggcatgaacccgggaggcagggcttgcagtgagccaagatcatgccgctgcactccagcctgggagacaaagtgagactccgtcaaaaaaaaaaaaaa

SEQ ID NO: 1965 - DNA, 157 bp, Artificial Sequence; identical to SEQ ID NO: 1500
  Synthetic polypeptide

SEQ ID NO: 1966 - DNA, 1058 bp, Artificial Sequence
  Synthetic polypeptide
atgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggagaatcacctgagcaccagaattcgaga

SEQ ID NO: 1967 - DNA, 568 bp, Artificial Sequence
  Synthetic polypeptide
atgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtaaagtggaattgcatgggaaaatcatggaagttgattactcagtctctaaaaagctaaggagcaggaaaattcagattcgaaacatccctcctcacctgcagtgggaggtgttggatggacttttggctcaatatgggacagtggagaatgtggaacaagcctaaagaagtaattcagaagaacacacaatccagtgatgtttgcaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaaaatgtactgatacaaaatactcatataaaagtgtt

SEQ ID NO: 1968 - DNA, 379 bp, Artificial Sequence
  Synthetic polypeptide
atgttctcatgtcctggacactaccacgttgatggctttctaaatccagggagcaggaaaattcagattcgaaacatccctcctcacctgcagtgggaggtgttggatggacttttggctcaatatgggacagtggagaatgtggaacaagcctaaagaagtaattcagaagaacacacaatccagtgatgtttgcaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaaaatgtactgatacaaaatactcatataaaagtgtt

SEQ ID NO: 1969 - DNA, 195 bp, Artificial Sequence
  Synthetic polypeptide
atgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1970 - DNA, 438 bp, Artificial Sequence
  Synthetic polypeptide
atgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1971 - DNA, 332 bp, Artificial Sequence
  Synthetic polypeptide
atgtctcgggagatgcaggatgtagacctcgctgaggtgaagcctttggtggagaaaggggagaccatcaccggcctcctgcaagagtttgatgtccagacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1972 - DNA, 240 bp, Artificial Sequence
  Synthetic polypeptide
atgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1973 - DNA, 489 bp, Artificial Sequence
  Synthetic polypeptide
atggcagtccctccacctgggatcatgaagcaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1974 - DNA, 471 bp, Artificial Sequence
  Synthetic polypeptide
atgacggtgccagctgcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1975 - DNA, 600 bp, Artificial Sequence
  Synthetic polypeptide
atgtcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcaggggcgtccgcatacactgcttccctgcccacacgctttactcatcaggttcccatgaccccttcagcgtcacttcttccaagaagccctccctgatcatctgagcacggcagg

SEQ ID NO: 1976 - DNA, 371 bp, Artificial Sequence; identical to SEQ ID NO: 1008
  Synthetic polypeptide

SEQ ID NO: 1977 - DNA, 272 bp, Artificial Sequence; identical to SEQ ID NO: 1009
  Synthetic polypeptide

SEQ ID NO: 1978 - DNA, 3992 bp, Artificial Sequence; identical to SEQ ID NO: 120
  Synthetic polypeptide

SEQ ID NO: 1979 - DNA, 3845 bp, Artificial Sequence; identical to SEQ ID NO: 121
  Synthetic polypeptide

SEQ ID NO: 1980 - DNA, 1515 bp, Artificial Sequence
  Synthetic polypeptide
atggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggctgggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcaggcactatttacaataacaaagacatggaaccaacccaaatgcctgtcaatgatagcctggataaagaaaatgtggtacatatacaccatggaatactatgcagccataaaaaggaatgagaacccgtcctttgtggggacatggatgaagctggaagccatcatcctcagcaaactaacacaggaacagaaaaccaaacaccacatgttctcacccataagtggaagttgaacactgagaacacatggacacagagaagggaacaacacacatgaaggcctgtagggggttgggggttgagggaagggaacttaaaggatgggtccataggtgcagcaaaccaccatggcacatgtatacctatggaacaaacctgcatgttctgcactcgtatcccatttttagaagaaataatgaaaaaaaa

SEQ ID NO: 1981 - DNA, 3220 bp, Artificial Sequence; identical to SEQ ID NO: 248
  Synthetic polypeptide

SEQ ID NO: 1982 - DNA, 2721 bp, Artificial Sequence; identical to SEQ ID NO: 962
  Synthetic polypeptide

SEQ ID NO: 1983 - DNA, 2549 bp, Artificial Sequence; identical to SEQ ID NO: 963
  Synthetic polypeptide

SEQ ID NO: 1984 - DNA, 828 bp, Artificial Sequence
  Synthetic polypeptide
atgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgactctgttgaaagtacccagcagcaaagaaggttctcaccagatgcagctccttgatcttggccttctcagcctccattaactgtaagaaataaattcctttctttataaattacccagtttcaagtattgtgttataagcaacagaaaacaaagaca

SEQ ID NO: 1985 - DNA, 775 bp, Artificial Sequence
  Synthetic polypeptide
atgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggcacttggccaacaaaggtaagatgttttgcttaataaacaagttaaaaataaagcctgcatccaaacagatgaggacgcaagcaagcgcactcttcagatgtcacttctcacgggaggcctctgtgattgcagaaggaaaggccccagcagaactcaccatctgccgcctgaggctccaccacctcgaagacatccttgcaagatccacagactggcccagaccaggaggtttctgtcttcttcttgtgtcttcttcactctcctggactggttcgtgaaccctttctcctatctctgtttcctctggatgttaagtgctactttctttgttgtggaacgttaacctgtaacatgtatatactgattaagtacactattacgttgtcgtgtgcaatattggctgacatgtgcagtggcttgagcccgtgtgaccgcagctctcactactgagggaaaggagcactaagcagcatgcctccttgggaacgccgtgtggctcgtggctttagggattgaaatagcctcaataaaattctgacattgtgaaagacacaggcatgcttggatgtgattatctctaactttgcactgctcatgaca

SEQ ID NO: 1986 - DNA, 592 bp, Artificial Sequence
  Synthetic polypeptide
atggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgtgaactgtgagtccacttaagtggcttctctttcgcctctgccacccctgagacagcaggaccaaccctcccttcctcctcctcagcctgctctacgtgaagatgatgaggatgaagacctttatgacgatccacttccacttaatgaaaagtcagttcattttctcttccttgtgatttccttcattgcattttcttcctctagcttactttattataagaatccaatatataatacttgtaacatgcaaaatatatgttaatcgaccatttatgttattggcaaacattctggtcagcatcaggctatgagtaaattgtgggggagtcaaaaataatatgcagattttcaattgtgttgggggtggttcccccaacccctgagttgttcaaggattaactg

SEQ ID NO: 1987 - DNA, 770 bp, Artificial Sequence
  Synthetic polypeptide
atgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggctaaggtgtttcattgtaacctgaatggaccaag

SEQ ID NO: 1988 - DNA, 1193 bp, Artificial Sequence
  Synthetic polypeptide
atgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggctaaggtgtttcattgtaacctgaatggaccaag

SEQ ID NO: 1989 - DNA, 1705 bp, Artificial Sequence
  Synthetic polypeptide
atgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcaggctggagtgcagtggcgtgatctcagctcgctacaacctccacctcccagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggtgaggagcgtctttgcccagccgccccgtctgagaagtgaggagcccctccgcctggcagccgccccgtctgggaagtgaggagcgtctccgcccggcagccgccccgtccgggaggtggggggcagccgccgcccggccagccgccctgtccaggagggaggtggggggcaacccccgcccggccagccaccccgtccgggagggaggttgggggtgcctctgaccggccgccccgtctgggaagtgaggagcccctctgcccggcggccaccccgtctgggaggagtacccaacagctcgttgagaacgggccatgatgacgatggcggttttgtcgaatagaaaagggggaaatgtggggaaaagaaagagagatcagattgttactgtgtctgtgtggaaagaggtagacatgggagactccattttgttctgtactaagaaaaattcttctgccttgggatgctgttaatctataaccttacccccaaccccgtgctctctgaaacatgtgctgtgtccactcagggttaaatggataaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactattaaaaaaaaaaa

SEQ ID NO: 1990 - DNA, 817 bp, Artificial Sequence
  Synthetic polypeptide
atgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaacttcactttccttatgtgcaaaatggataacaccatggcataagacaatcccatgaagataagatataaaagaagataatgtttgaaaag

SEQ ID NO: 1991 - DNA, 1231 bp, Artificial Sequence; identical to SEQ ID NO: 1238
  Synthetic polypeptide

SEQ ID NO: 1992 - DNA, 193 bp, Artificial Sequence
  Synthetic polypeptide
atggcctggtggaaatcctgggagaatgaataaacagactaggttgaatccatacaatggaatggtagcagacaataaaaagaaaatgaactattgatgccccctactgcacagcagaagctctgaatcgtgttcctgaatgaaagaagtcaggtatgaaagaataaacattgtatgattccatttatatgaa

SEQ ID NO: 1993 - DNA, 254 bp, Artificial Sequence
  Synthetic polypeptide
atggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggctcaccttgccccact

SEQ ID NO: 1994 - DNA, 966 bp, Artificial Sequence
  Synthetic polypeptide
atggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaa

SEQ ID NO: 1995 - DNA, 432 bp, Artificial Sequence
  Synthetic polypeptide
atggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaa

SEQ ID NO: 1996 - DNA, 190 bp, Artificial Sequence
  Synthetic polypeptide
atggaggcggtggtgttcgtcttctctctcctcgattgttgcgcgctcatcttcctctcggtctacttcgccagttgcagtggctgacacctgtccccagtactttgggaggccgaggagggagaatcacttgagcccagcggttcgagaccagctctggtaacatagggagacttcctctctacaaaaa

SEQ ID NO: 1997 - DNA, 361 bp, Artificial Sequence; identical to SEQ ID NO: 1916
  Synthetic polypeptide

SEQ ID NO: 1998 - DNA, 2312 bp, Artificial Sequence
  Synthetic polypeptide
atggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaaccactggtacctctcgccaggaccactgcagcagccttccagccggccctgtttcctcatccaaaccattcacctgccagcagcaacactgatcttcctgagatatacccagaccaggccactcccctgtccacgtcctgcaggggttcctgctgcgtgcaatatagaagccaaatgcct

SEQ ID NO: 1999 - DNA, 3093 bp, Artificial Sequence; identical to SEQ ID NO: 341
  Synthetic polypeptide

SEQ ID NO: 2000 - DNA, 2979 bp, Artificial Sequence; identical to SEQ ID NO: 342
  Synthetic polypeptide

SEQ ID NO: 2001 - DNA, 3078 bp, Artificial Sequence; identical to SEQ ID NO: 343
  Synthetic polypeptide

SEQ ID NO: 2002 - DNA, 3072 bp, Artificial Sequence; identical to SEQ ID NO: 346
  Synthetic polypeptide

SEQ ID NO: 2003 - DNA, 1935 bp, Artificial Sequence; identical to SEQ ID NO: 347
  Synthetic polypeptide

SEQ ID NO: 2004 - DNA, 1096 bp, Artificial Sequence; identical to SEQ ID NO: 348
  Synthetic polypeptide

SEQ ID NO: 2005 - DNA, 902 bp, Artificial Sequence; identical to SEQ ID NO: 349
  Synthetic polypeptide

SEQ ID NO: 2006 - DNA, 874 bp, Artificial Sequence; identical to SEQ ID NO: 350
  Synthetic polypeptide

SEQ ID NO: 2007 - DNA, 1168 bp, Artificial Sequence; identical to SEQ ID NO: 1703
  Synthetic polypeptide

SEQ ID NO: 2008 - DNA, 1563 bp, Artificial Sequence
  Synthetic polypeptide
atggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggccgaagctggactgtactgctgccatctcggctcactgcaacctccctgcctgattctcctgcctcagcctgccgagtgcctgcgattgcaggcgtgcgccaccacgcctgactggttttcgtatttttttggtggaaacggggtttcgctgtgttggccgggctggtctccagctcctaaccgcgagtgatctgccagcctcggcctcccgaggtgccgggattgcagacggagtctggttcactcagtgctcaatggtgcccaggctggagtgcagtggcgtgatctcggctcgctacaacctccacctcccagccgcctgccttggcctcccaaagtgccgagagtgcagcctctgcccggccgccaccccgtctgggaagtgaggagtgtctctgcctggctgcccatcgtctgggacgtgagcagcccctctgcctggctgcccagtctggaaagtgaggagcgtctctgccccgccgccatcccatctaggaagtgaggagcgcctcttcccggccgccatcccatctaggaagtgaggagcgtctctgcccggccgcccatcgtctgagatgtggggagcacctctgcccagccgcaaccccatctgggaggtgaggagcaactctgcccagccgccccgtctgagaagtgaggagaccctctgcctggcaaccgccccgtctgagaagtaaggagcccctctgcccagcagccgccccgtctgagaagtgaggagcccctccgcccggcagccaccctgtctgggaagtgaggagcgtctccgcccggcagccaccccgtccgggagggaggtgggggtcagcccccgccaggccagccgccccatccgggaggaaggtggggggttcagccccccgcccggccagccgccccgtctgggagggaggtcggggggtcagtcccccgtccggccagccgccctgtctgggaggtgaggggcgcctctgcccagctgcccctactgggaagtgaggagcccctctgcccggccagccgccccatccgggagggaggtgggggggtcagcccgccgcccgggcagccgccccgtccgggagggaggtggggggtcagccccccgcccggccagccgccccgtccgggaggcgaggggcgcctctgcccggccgtccctactgggaagtgaggagcccctctgcccggccaccaccccgtctgggaggtgtacccaacagctcattgagagcgggccatgatgacagtggcggttttgtggagtggaggggggggagaggtggggaaaagattgagaaatcggatggttgccgtgtctgtgtagaaagaagtagacatgggagacttttcattttgttctgtactaagaaaaattctt

SEQ ID NO: 2009 - DNA, 906 bp, Artificial Sequence; identical to SEQ ID NO: 1888
  Synthetic polypeptide

SEQ ID NO: 2010 - DNA, 1077 bp, Artificial Sequence; identical to SEQ ID NO: 1889
  Synthetic polypeptide

SEQ ID NO: 2011 - DNA, 835 bp, Artificial Sequence
  Synthetic polypeptide
atgccggaaccagcgaagtccgctcccgcgcccaagaagggctcgaagaaagccgtgactaaggcgcagaagaaggacggcaagaagcgcaagcgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaccaaggccgtcaccaagtacaccagcgctaaggagggactttctctggaatttcctgatatgaccaagaaagcttcttatcaaaagaagcacaattgccttcggttacctcattatctactgcagaaaagaagacgagaatgcaaccatacctagatggacttttccacaagctaaagctggcctcttgatctcattcagattccaaagagaatcatttacaagttaatttctgtctccttggtccattccttctctctaataatcatttactgttcctcaaagaattgtctacattacccatctcctcttttgcctctgagaaagagtatataagcttctgtaccccactggggggttggggtaatattctgtggtcctcagccctgtaccttaataaatttgtatgccttttctcttattaatcttgtcagttgattttcagtgaactttcagaggccaaaagggaggttttctcttggcccctgca

SEQ ID NO: 2012 - DNA, 5801 bp, Artificial Sequence
  Synthetic polypeptide
atggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaagataaacccgggacccacttcactccagtgcctccgacgcctcctgatgcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtgacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtgaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtgaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtgagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcaggccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgtgcggctcagatggggtcacctacagcaccgagtgtgagctgaagaaggccaggtgtgagtcacagcgagggctctacgtagcggcccagggagcctgccgaggccccaccttcgccccgctgccgcctgtggcccccttacactgtgcccagacgccctacggctgctgccaggacaatatcaccgcagcccggggcgtgggcctggctggctgccccagtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacaccctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctgacgcttctgcgcctgcgacctgtgcggagatgcgctgtgagttcggtgcgcggtgcgtggaggagtctggctcagcccactgtgtctgcccgatgctcacctgtccagaggccaacgctaccaaggtctgtgggtcagatggagtcacatacggcaacgagtgtcagctgaagaccatcgcctgccgccagggcctgcaaatctctatccagagcctgggcccgtgccaggaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctggggggctcgagcccttggagggcagcagcgtggccacccctgggccacctgtcgagagggcttcctgctacaactccgcgttgggctgctgctctgatgggaagacgccctcgctggacgcagagggctccaactgccccgccaccaaggtgttccagggcgtcctggagctggagggcgtcgagggccaggagctgttctacacgcccgagatggctgaccccaagtcagaactgttcggggagacagccaggagcattgagagcaccctggacgacctcttccggaattcagacgtcaagaaggattttcggagtgtccgcttgcgggacctggggcccggcaaatccgtccgcgccattgtggatgtgcactttgaccccaccacagccttcagggcacccgacgtggcccgggccctgctccggcagatccaggtgtccaggcgccggtccttgggggtgaggcggccgctgcaggagcacgtgcgatttatggactttgactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaaggtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggaccaacctgtgccgatgagaagagcccctgccagcccaacccctgccatggggcggcgccctgccgtgtgctgcccgagggtggtgctcagtgcgagtgccccctggggcgtgagggcaccttctgccagacagcctcggggcaggacggctctgggcccttcctggctgacttcaacggcttctcccacctggagctgagaggcctgcacacctttgcacgggacctgggggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagccaggcgtggtggtacacacctgtagctccagctactccggaggctgaggcaggaggatcacttgaatccaggaggttgaggcagcagcaagctgtgattgcaccactgcactccagcctgggtgacagagcgagaacctgtctaaaaaa

SEQ ID NO: 2013 - DNA, 708 bp, Artificial Sequence
  Synthetic polypeptide
ccgctacgacctgggcaagggggcagcggtcatcaggagcagggagccagtcaccctgggagcctggaccagggtctcactggagcgaaacggccgcaagggtgccctgcgtgtgggcgacggcccccgtgtgttgggggagtccccgaaatcccgcaaggttccgcacaccgtcctcaacctgaaggagccgctctacgtagggggcgctcccgacttcagcaagctggcccgtgctgctgccgtgtcctctggcttcgacggtgccatccagctggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaaggggctggtggagaagtcagcgggggacgtggataccttggcctttgacgggcggacctttgtcgagtacctcaacgctgtgaccgagagccaggcgtggtggtacacacctgtagctccagctactccggaggctgaggcaggaggatcacttgaatccaggaggttgaggcagcagcaagctgtgattgcaccactgcactccagcctgggtgacagagcgagaacctgtctaaaaaa

SEQ ID NO: 2014 - DNA, 47 bp, Artificial Sequence
  Synthetic polypeptide
atgagcctgcagagcgcgcagtacctccggattgctgggaggagtaa

SEQ ID NO: 2015 - DNA, 2179 bp, Artificial Sequence
  Synthetic polypeptide
atgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgggctccaccaggtcctcacagagaaaatgtgagaagaatctcatgcttccagtagggggagcagacaaagaaccattttgaaatagacagagcattctgttcttaaggcagtctgccgtcaggaacaactatttaaccacaggcagccctgctgaggttttatcagagcctggtctagctggagaaagggaaatacccaaccccagctccctccagctatgctgaccctacttaaagaggtgaaaaaagcctcagaagcacttgtgaagttcacagccaaggggcgcaggctcactaaaagactgagacctaattctactcataggtctatagaatacctcccctcacctcatacctcatcactacattactaaagcttatttatcagtttcttccatccattttcaacaaaaaaattacaaagcatacttcaaggtagaaaacagtttgaaaagacagagcaagtaccagaaccacactcagatatggcagggatattggaattattagatcgggaatttaaaacaaccatgattaacaagctaagagcacaaatgaacaaggtacacaacatgcaagaacagatgggtaatgaaagcagatagacagaaattctaataataaaaaataaatgctagagataaaaaacattataacagaaatgacgaacgccttttgtgggctcattagtagactagacacagctgacattagaatctgagcttgagggtatgtcaatagaactgttttttcagttctttctcaactgaaaagcaaaaataaaaaaagactgagaaaagaagaacagaatatgcaagaactgtgggggaaactatgaaagatgtaacttgtgtaaaaggaatactagaacaagaaatagagaaagcaacataataaatattggagaaagtaatgactgagaatttccaaaaattagtgtcagacataaaaaaatacctgtgtatattatattcaaactgtagaaaatgaaagataacaaaaatcctgaaagaagccatggttgggggggaaacaacttatctatagtggaacaaagataagaattaaatctcacttcctcacagaaaccttgcaagcaagaaaagactggagtaaaatatttactgttgggtgagaaaacagcaacacggaattctatatcttgctaaattatccttcaaaaatgaagaaaaaataaagactttctcaagacaaacaaaaatgaagagaatatgttgccagtagtcctgccttgcaagaaatgttaaaagaagctcttcaccaagaaggaaaattatataggtcagaaactcggatctacataaagaaaggaaaagcattagagaagaaataagatctaacagataaatgttcgttcaaaataataatagcaacaatgtcttcaatgtttatactttatgtgtaagtgaaatgaatgacagcattgatacaaaggatgcgagggaggaattagcgata

SEQ ID NO: 2016 - DNA, 1581 bp, Artificial Sequence
  Synthetic polypeptide
ggaccctgctgcaggagcagggcaccaagactgtgaggcagaacctggagccgttgttcgagcagtacatcaacaacctcaggaggcagctggacagcatcgggctccaccaggtcctcacagagaaaatgtgagaagaatctcatgcttccagtagggggagcagacaaagaaccattttgaaatagacagagcattctgttcttaaggcagtctgccgtcaggaacaactatttaaccacaggcagccctgctgaggttttatcagagcctggtctagctggagaaagggaaatacccaaccccagctccctccagctatgctgaccctacttaaagaggtgaaaaaagcctcagaagcacttgtgaagttcacagccaaggggcgcaggctcactaaaagactgagacctaattctactcataggtctatagaatacctcccctcacctcatacctcatcactacattactaaagcttatttatcagtttcttccatccattttcaacaaaaaaattacaaagcatacttcaaggtagaaaacagtttgaaaagacagagcaagtaccagaaccacactcagatatggcagggatattggaattattagatcgggaatttaaaacaaccatgattaacaagctaagagcacaaatgaacaaggtacacaacatgcaagaacagatgggtaatgaaagcagatagacagaaattctaataataaaaaataaatgctagagataaaaaacattataacagaaatgacgaacgccttttgtgggctcattagtagactagacacagctgacattagaatctgagcttgagggtatgtcaatagaactgttttttcagttctttctcaactgaaaagcaaaaataaaaaaagactgagaaaagaagaacagaatatgcaagaactgtgggggaaactatgaaagatgtaacttgtgtaaaaggaatactagaacaagaaatagagaaagcaacataataaatattggagaaagtaatgactgagaatttccaaaaattagtgtcagacataaaaaaatacctgtgtatattatattcaaactgtagaaaatgaaagataacaaaaatcctgaaagaagccatggttgggggggaaacaacttatctatagtggaacaaagataagaattaaatctcacttcctcacagaaaccttgcaagcaagaaaagactggagtaaaatatttactgttgggtgagaaaacagcaacacggaattctatatcttgctaaattatccttcaaaaatgaagaaaaaataaagactttctcaagacaaacaaaaatgaagagaatatgttgccagtagtcctgccttgcaagaaatgttaaaagaagctcttcaccaagaaggaaaattatataggtcagaaactcggatctacataaagaaaggaaaagcattagagaagaaataagatctaacagataaatgttcgttcaaaataataatagcaacaatgtcttcaatgtttatactttatgtgtaagtgaaatgaatgacagcattgatacaaaggatgcgagggaggaattagcgata

SEQ ID NO: 2017 - DNA, 1849 bp, Artificial Sequence
  Synthetic polypeptide
atgtctcgccagtcaagtgtgtccttccggagcgggggcagtcgtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgggctccaccaggtcctcacagagaaaatgtgagaagaatctcatgcttccagtagggggagcagacaaagaaccattttgaaatagacagagcattctgttcttaaggcagtctgccgtcaggaacaactatttaaccacaggcagccctgctgaggttttatcagagcctggtctagctggagaaagggaaatacccaaccccagctccctccagctatgctgaccctacttaaagaggtgaaaaaagcctcagaagcacttgtgaagttcacagccaaggggcgcaggctcactaaaagactgagacctaattctactcataggtctatagaatacctcccctcacctcatacctcatcactacattactaaagcttatttatcagtttcttccatccattttcaacaaaaaaattacaaagcatacttcaaggtagaaaacagtttgaaaagacagagcaagtaccagaaccacactcagatatggcagggatattggaattattagatcgggaatttaaaacaaccatgattaacaagctaagagcacaaatgaacaaggtacacaacatgcaagaacagatgggtaatgaaagcagatagacagaaattctaataataaaaaataaatgctagagataaaaaacattataacagaaatgacgaacgccttttgtgggctcattagtagactagacacagctgacattagaatctgagcttgagggtatgtcaatagaactgttttttcagttctttctcaactgaaaagcaaaaataaaaaaagactgagaaaagaagaacagaatatgcaagaactgtgggggaaactatgaaagatgtaacttgtgtaaaaggaatactagaacaagaaatagagaaagcaacataataaatattggagaaagtaatgactgagaatttccaaaaattagtgtcagacataaaaaaatacctgtgtatattatattcaaactgtagaaaatgaaagataacaaaaatcctgaaagaagccatggttgggggggaaacaacttatctatagtggaacaaagataagaattaaatctcacttcctcacagaaaccttgcaagcaagaaaagactggagtaaaatatttactgttgggtgagaaaacagcaacacggaattctatatcttgctaaattatccttcaaaaatgaagaaaaaataaagactttctcaagacaaacaaaaatgaagagaatatgttgccagtagtcctgccttgcaagaaatgttaaaagaagctcttcaccaagaaggaaaattatataggtcagaaactcggatctacataaagaaaggaaaagcattagagaagaaataagatctaacagataaatgttcgttcaaaataataatagcaacaatgtcttcaatgtttatactttatgtgtaagtgaaatgaatgacagcattgatacaaaggatgcgagggaggaattagcgata

SEQ ID NO: 2018 - DNA, 2713 bp, Artificial Sequence; identical to SEQ ID NO: 1273
  Synthetic polypeptide

SEQ ID NO: 2019 - DNA, 228 bp, Artificial Sequence; identical to SEQ ID NO: 1274
  Synthetic polypeptide

SEQ ID NO: 2020 - DNA, 572 bp, Artificial Sequence; identical to SEQ ID NO: 159
  Synthetic polypeptide

SEQ ID NO: 2021 - DNA, 281 bp, Artificial Sequence
  Synthetic polypeptide
atgagtgagtcgagctcgaagtccagccagcccttggcctccaagcaggaaaaggacggcactgagaagcggggccggggcaggccgcgcaagcagcctccggtgagtcccgggacagcgctggtagggagtcagaaggagcccagcgaagtgccaacacctaagagacctcggggccgaccaaagggaagcaaaaacaagggtgctgccaagacccgggcccaccatcaccaccgcctctggccgccacccccatcttccacctgtgccctcaccaccac

SEQ ID NO: 2022 - DNA, 248 bp, Artificial Sequence
  Synthetic polypeptide
atgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccgggcccaccatcaccaccgcctctggccgccacccccatcttccacctgtgccctcaccaccac

SEQ ID NO: 2023 - DNA, 1487 bp, Artificial Sequence
  Synthetic polypeptide
atggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 2024 - DNA, 1538 bp, Artificial Sequence
  Synthetic polypeptide
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 2025 - DNA, 1427 bp, Artificial Sequence
  Synthetic polypeptide
atggggtacttccggtgtgcacgtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggattttggaggcaacatcaacgtggagaccatcagtgcctttattgacggcggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaa

SEQ ID NO: 2026 - DNA, 3308 bp, Artificial Sequence; identical to SEQ ID NO: 428
  Synthetic polypeptide

SEQ ID NO: 2027 - DNA, 3203 bp, Artificial Sequence; identical to SEQ ID NO: 429
  Synthetic polypeptide

SEQ ID NO: 2028 - DNA, 2849 bp, Artificial Sequence; identical to SEQ ID NO: 430
  Synthetic polypeptide

SEQ ID NO: 2029 - DNA, 388 bp, Artificial Sequence; identical to SEQ ID NO: 431
  Synthetic polypeptide

SEQ ID NO: 2030 - DNA, 55 bp, Artificial Sequence; identical to SEQ ID NO: 291
  Synthetic polypeptide

SEQ ID NO: 2031 - DNA, 25 bp, Artificial Sequence
  Synthetic polypeptide
atgagcgtcctttcgtttttttaaa

SEQ ID NO: 2032 - DNA, 1091 bp, Artificial Sequence
  Synthetic polypeptide
atggcctggtggaaatcctgggggcctcatagacattcactccacccaacaaccacagaatatacattcttcctatctgtacacagaacatattctcagatcaaccatatgctgagtcataaagcaagtctcaataaattttaaaaaattgaaattataccaaacacactcttggaccacagtgcgataaaaatagaaactaatatcaagaagatctctcaaaactacacaaatacatggatattaaacaactttttcctgattaactcctaggtgaaaatcaaaattaaggcagaaataaaaaaatctttgaaagtaatgaaaatggagatacaacttaacaaagtctctgggatacagccaaagcagtgttaagaggaaagtttataacgttaaatgccttcaccaagaagttaaaacaatctcaaattaacagtctaagtttgcacctagaagaactagagaaaaagagcaaaccaaccccaaagctagcagaagaaaataaataactaaaattaaagaagaacttaatgaaattgagatgcaaaaatccatacaaaagataaatgaaaccaaaagttgattttcaaaaaaataaacaagactgagagaccactagctagattaacaaagaaaaaagaatttccaaataagtactgtgagaaatgacaaagatattacaattcatcttcatttgcagatgaagatactgcagcttagtcagcagactaagtcacctaaatgctctgccagaagcagaatttgtactcaggaatgtccaactgcaaagtccatgtgcttgaacagtatggcatactgatacatgcagaaatacaaaagatcctcagaaaatactgtgagtaattctatgcacacaaattagaaaatctagaggaaatggataaattcctgggaacatacaatctcccaagattgaatcaggaagagactgataccctgactagaccaatatcaagctctgaaattaaaccaataataaaaaacctaccaacgacaacaacaaaaagccctggactagatggattcacagctaaattctatcagacatacaaagaactggtaccaatcct

SEQ ID NO: 2033 - DNA, 393 bp, Artificial Sequence; identical to SEQ ID NO: 1400
  Synthetic polypeptide

SEQ ID NO: 2034 - DNA, 272 bp, Artificial Sequence; identical to SEQ ID NO: 1401
  Synthetic polypeptide

SEQ ID NO: 2035 - DNA, 3995 bp, Artificial Sequence
  Synthetic polypeptide
atggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgcgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgggcgtagtggcagctgcctgtaatcccagctactcgggaggctgaggcaggagaatcacttgaacccgggaggcggaggttgcagtgagccatcacgccattgcactccagcctggcgactgagtgacactccgtctcaaaaaacaaagaaacaa

SEQ ID NO: 2036 - DNA, 3836 bp, Artificial Sequence
  Synthetic polypeptide
gggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgggcgtagtggcagctgcctgtaatcccagctactcgggaggctgaggcaggagaatcacttgaacccgggaggcggaggttgcagtgagccatcacgccattgcactccagcctggcgactgagtgacactccgtctcaaaaaacaaagaaacaa

SEQ ID NO: 2037 - DNA, 506 bp, Artificial Sequence; identical to SEQ ID NO: 1096
  Synthetic polypeptide

SEQ ID NO: 2038 - DNA, 1412 bp, Artificial Sequence
  Synthetic polypeptide
atggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggcaggagaatggcgtgaacctgggagtcggagcttgcagtgagccgagatggcgccactgcactccagcctgggcgacagagcgagactccgtctcagaaaaaa

SEQ ID NO: 2039 - DNA, 102 bp, Artificial Sequence; identical to SEQ ID NO: 258
  Synthetic polypeptide

SEQ ID NO: 2040 - DNA, 82 bp, Artificial Sequence; identical to SEQ ID NO: 257
  Synthetic polypeptide

SEQ ID NO: 2041 - DNA, 4120 bp, Artificial Sequence; identical to SEQ ID NO: 1356
  Synthetic polypeptide

SEQ ID NO: 2042 - DNA, 4132 bp, Artificial Sequence; identical to SEQ ID NO: 1357
  Synthetic polypeptide

SEQ ID NO: 2043 - DNA, 4120 bp, Artificial Sequence; identical to SEQ ID NO: 1358
  Synthetic polypeptide

SEQ ID NO: 2044 - DNA, 4024 bp, Artificial Sequence; identical to SEQ ID NO: 1359
  Synthetic polypeptide

SEQ ID NO: 2045 - DNA, 4531 bp, Artificial Sequence; identical to SEQ ID NO: 1360
  Synthetic polypeptide

SEQ ID NO: 2046 - DNA, 4054 bp, Artificial Sequence; identical to SEQ ID NO: 1361
  Synthetic polypeptide

SEQ ID NO: 2047 - DNA, 4078 bp, Artificial Sequence; identical to SEQ ID NO: 1362
  Synthetic polypeptide

SEQ ID NO: 2048 - DNA, 4201 bp, Artificial Sequence; identical to SEQ ID NO: 1363
  Synthetic polypeptide

SEQ ID NO: 2049 - DNA, 4189 bp, Artificial Sequence; identical to SEQ ID NO: 1364
  Synthetic polypeptide

SEQ ID NO: 2050 - DNA, 210 bp, Artificial Sequence; identical to SEQ ID NO: 1365
  Synthetic polypeptide

SEQ ID NO: 2051 - DNA, 3304 bp, Artificial Sequence
  Synthetic polypeptide
atggcaccaccagctcataaaagcatacttgaacgcagtgaaaatgttctcatgtctccatggaaagggaaattaattgttcaagaccgtatgctatgtgatatagctctttggtccacttacggtgcaatgattccaacacagctaccgcaggaactagattttaaatatgtaatgaaagtgtcttccttgaaaaaaagactaccagaggctgccttcagaaaacagaattacttggaggagaaagtctgttttcaagatttgtgcttcaatttgtatgaggtagaactgtcaaacagacaaggggaaaatatagataaattaacagaatgtattaaaaacaagcaattggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagttgaactcttatttttcagaccctagtgcttacattttggaagtgtctactgctttggacttgctagcagagcatcctcagtctccttgtgtttcagacggaatttgtgatgctggattttccttagttatgactccagatcctgaatttcttgtctcagaggcagaagtgagaaaagaaactgaaacaaaaaaggattctgaagaaatgttgaaagcaaagaagagagtttttccattgagtccagcgtcaaatctgagagtgcagcctaagaggaaggccagcatgccccacatggtgcagagtaaaaaggtgaacttgtgccgcccctttcccaaaagaactgcttccagagcagacaacagctcggactctccaacaactcttaagttagttaaaggacagtttcctcagaaaagaaaaagaggtgcggaagtgctgactgcacagtttgtacagaaaaccaaattggataggaaaaaccaagaagctcctatttctaaagatgttccagtgccaacaaatgctaaaagggcaaggaaacaagagaaatctccagtcaaaactgttccaagggctaagccacctgtgaagaaatctccacaaaaacagagagtaaatatagtaaaaggcaatgagaaccccagaaacagaaagcagctacaacctgtcaaaggagaaactgcttcaaagcttcaatcagaaatttcaagaggttgtcaagaagatgggattagcataaatagtgttcaaccagaaaataccacagcggctcacaatgatcttcctgaaaactccatcgtcaactatgactcccaggccctaaatatgttagccgatctagcattaagctctgctacttcttccacaccagtatctgaggctagaaatcttcactgttcctctgaattgccacaaaatgatgttttgctctctaaagaaaattctttgcgaggtacatctgaccatgaatatcatagaggagttaaaactcaaaaaggtgaattactacctaacccatcttctgataggaagagtaattctggatcagacttaacagttagccaagatgaagaaagcttggttccttgtagtcaggcccctgctaaagcccagtcagcacttactgaggaaatgctagaatcttcagatgcaagccaaagctcttctgtttctgtggaacattcatatgccctgctccttacagaacattcaaagaaacatctacaggagagagagatactaagccctctgtttcccaggaatgggacaaaaagccctgaagcagcaaccccagtggggaaagtcatgccatttcggcatcagcccggccttttgcttcagcaaaagcctcctgacgaccccgtggtgaagcccaaggatcgaccaccgtctgcccgtgtgaaaaaatcttcttgctctcgtatagtgcttagctgtgatgactccgttaagatcactttcaaatgtgaaacagaatatgcattcagtttagacagcaaatataccaacaacccactggagaaaactgtagtaagagcattacatgggccctggaatactgatttgcctgataatgtggaagaagtgaagcttttacttcatatgtgggtagctctgttttacagcaatcagaacaaaatcatacgatcttcccgaaaggttgtagaacacagcaacccagcaaaatatgtgtctataaatagcacgttagaatcttgtgagctccgtgaaattgaggagtcccttggtttggaaaaatgttctgcagactctctgttggagactaacgaaatttccagggctcatgctgctgaagtatccttccgtgatcctaactgcttgcttcctttcattaaaacaccacttacccaaggcttggaactctgtgtacaaaatgaacagaaaaaaacttttgcaagagagtgtgatccagacacccaagaagaccagaatttcatctgttcttacaataatgaggtaactggggaagaagctaaacaagaatcattggagacttctaatcttgtgctttcgggtattggaagtacacaaactaatggaccttctgttcctagtgaagaagaaattgttcagccactggatagcacaagagtggcttcttacagtggcactgttactcaagccacattcaccaggacttacgatgggcctggcagtcagccagtgatatgtcagagctctgtgtacggcacccttgaaaacaaagtggatattcttgatgcagcagtgcaaacaaaaacaggtactttacaggaccttatccaacatggcagccccataaacaatgaatgtcacccttccttggaaagaaaggatgataatatggggtgtgcagtgattaacccggaaccaattactctcacctttgaaaaaaatgcacatgtaccaatacagacagaaggtgtaaatactgctgatgaacctacaacctttataaacaaaagctcaaggtcctgaattttttagcacgtgaacagatcctgagactaaaaagtttgaaaac

SEQ ID NO: 2052 - DNA, 718 bp, Artificial Sequence; identical to SEQ ID NO: 1366
  Synthetic polypeptide

SEQ ID NO: 2053 - DNA, 569 bp, Artificial Sequence; identical to SEQ ID NO: 426
  Synthetic polypeptide

SEQ ID NO: 2054 - DNA, 4191 bp, Artificial Sequence
  Synthetic polypeptide
atggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggatgggtccagactgtttgcagactggccatggtccttgggccacactggaagaagaactg

SEQ ID NO: 2055 - DNA, 1770 bp, Artificial Sequence
  Synthetic polypeptide
atggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggatgtcagctccagatgggcatttttgtcgtttctcttgactgctgtatcctcagtatataaaacagtgcatagcaggtgctgaacaaatatt

SEQ ID NO: 2056 - DNA, 1465 bp, Artificial Sequence
  Synthetic polypeptide
ggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggatgtcagctccagatgggcatttttgtcgtttctcttgactgctgtatcctcagtatataaaacagtgcatagcaggtgctgaacaaatatt

SEQ ID NO: 2057 - DNA, 1470 bp, Artificial Sequence; identical to SEQ ID NO: 1592
  Synthetic polypeptide

SEQ ID NO: 2058 - DNA, 202 bp, Artificial Sequence; identical to SEQ ID NO: 1593
  Synthetic polypeptide

SEQ ID NO: 2059 - DNA, 128 bp, Artificial Sequence; identical to SEQ ID NO: 1082
  Synthetic polypeptide

SEQ ID NO: 2060 - DNA, 679 bp, Artificial Sequence; identical to SEQ ID NO: 1729
  Synthetic polypeptide

SEQ ID NO: 2061 - DNA, 3825 bp, Artificial Sequence; identical to SEQ ID NO: 158
  Synthetic polypeptide

SEQ ID NO: 2062 - DNA, 939 bp, Artificial Sequence
  Synthetic polypeptide
atgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgagggattcctccagggattggagagagagaaatgtggaatgcagaaatgtacatgtaggatattgatttcacttatgtgaaataaa

SEQ ID NO: 2063 - DNA, 1416 bp, Artificial Sequence
  Synthetic polypeptide
atggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgagggattcctccagggattggagagagagaaatgtggaatgcagaaatgtacatgtaggatattgatttcacttatgtgaaataaa

SEQ ID NO: 2064 - DNA, 324 bp, Artificial Sequence
  Synthetic polypeptide
atgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgagggattcctccagggattggagagagagaaatgtggaatgcagaaatgtacatgtaggatattgatttcacttatgtgaaataaa

SEQ ID NO: 2065 - DNA, 652 bp, Artificial Sequence
  Synthetic polypeptide
atgatggcaggaatgaaaatccagcttgtatgcatgctactcctggctttcagctcctggagtctgtgctcagattcagaagaggaaatgaaagcattagaagcagatttcttgaccaatatgcatacatcaaagattagtaaagcacatgttccctcttggaagatgactctgctaaatgtttgcagtcttgtaaataatttgaacagcccagctgaggaaacaggagaagttcatgaagaggagcttgttgcaagaaggaaacttcctactgctttagatggctttagcttggaagcaatgttgacaatataccagctccacaaaatctgtcacagcagggcttttcaacactgggaggcacggtggctcacgcctgtaatcccagcactttgggaggccgagacgggcggatcacgaggtcaagagatggagaccatcccggctaacacggtgaaaccccgtctctactaaaaatacaaaaaattagccgggcgtagtggccggcgcctgtagtcccagctactggggaggctgaggcaggagaatggcctgaacccgagaggtggagcttgcagtgagctgagatcacggcactgcactccagcctgggcgacagagcgagactccatctcgagcaaacaaacaaaaa

SEQ ID NO: 2066 - DNA, 1119 bp, Artificial Sequence
  Synthetic polypeptide
atggaggatttcatcgtgatctcggacgacagcggctctgagagctccgggggcgcccgcccgggccggtcgcggaggccgcgccgggccctgtcgcgaacctccggcgcgctgccccgccggaccgtgaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatccatctaggaagtgaggagcgtctctgcccggctgcccattgtctgagatgtggggagcgcctctgccccgccgccccatctgggatgtgaggagcgcctctgcctggccgagaccccgtctgggaggtgacgagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccgacgcccggccagccgtgccatccaggagggggggggggtcagccccccgcctggccagccgtgccgtccgggagggaggtggggggtcagccccccgcccggccagccgccccgtctgggaggtgaggggc

SEQ ID NO: 2067 - DNA, 2364 bp, Artificial Sequence
  Synthetic polypeptide
atggcaccagcatctgcttctggtgaggacctcaggaagcttccaaccatggcagaggtgaatggggagcaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatccatctaggaagtgaggagcgtctctgcccggctgcccattgtctgagatgtggggagcgcctctgccccgccgccccatctgggatgtgaggagcgcctctgcctggccgagaccccgtctgggaggtgacgagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccgacgcccggccagccgtgccatccaggagggggggggggtcagccccccgcctggccagccgtgccgtccgggagggaggtggggggtcagccccccgcccggccagccgccccgtctgggaggtgaggggc

SEQ ID NO: 2068 - DNA, 2421 bp, Artificial Sequence
  Synthetic polypeptide
atggaggatttcatcgtgatctcggacgacagcggctctgagagctccgggggcgcccgcccgggccggtcgcggaggccgcgccgggccctgtcgcgaacctccggcgcgctgccccgccggaccgtggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattacatccacaagatgtggcatacctgcaagacatgccacggtcaccaggagatgtgccacagtcaccaagtgatgtttcaccgtcaccagatgcaccacagtcaccagggggcatgccacacttaccgggagatgtgttacattcacctggagacatgccacactcatcaggggacgtgacacactcacctagagacatccctcacttaccaggagacaggcctgactttacccagaatgatgtacagaaccgtgacatgcctatggatatctcagctctgtcctctccaagctgctctcccagcccacagtctgaaactcccttagagaaagttccttggctctctgtcatggaaaccccagccagaaaagaaatatcactgtcagagcctgccaaacctgggtctgcccacgtacaatcacgaacaccacaaggtgggttgtacaacagaccatgcctgcatagactgaagtacttcttacgtcctccggttcatcacctcttctttcagacgctaataccggataaagacacaagagagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagctacatccagccaatgccaagacagtggagtgggactggaaactgctcacctatgtcatggaggaagagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatccatctaggaagtgaggagcgtctctgcccggctgcccattgtctgagatgtggggagcgcctctgccccgccgccccatctgggatgtgaggagcgcctctgcctggccgagaccccgtctgggaggtgacgagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggtcagccccgacgcccggccagccgtgccatccaggagggggggggggtcagccccccgcctggccagccgtgccgtccgggagggaggtggggggtcagccccccgcccggccagccgccccgtctgggaggtgaggggc

SEQ ID NO: 2069 - DNA, 4277 bp, Artificial Sequence
  Synthetic polypeptide
atggtggctgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctctcgccgccgctgctgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataaccccatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctacgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcagattgccttctctcagcacagcaattttatggacctggtacagttcttcgtgactttcttcagttgtttcctctctttgctcctggtggctgctgtggtttggaagatcaaacaaagttgttgggcctccagacgtagagagcaacctggatggaattggagaccgttattctaagtgaaataattcaggaatggaaaaccacacttcatatattctcacttacaagtgggaactaagccctgaggatgcaaaggcataagaatgatacagtggattttgaggactcgggggaaagagtgggagggggatgagggataaaatactatacatcgggtacagtgtacactgctcgggtgataggtgcaccagaatctcagaaatcaccatgaaagaacttattcatgtaaccaaacaccacctgttcccccaaaaacctattgaaataataaataaataaataaataaataaataaata

SEQ ID NO: 2070 - DNA, 2080 bp, Artificial Sequence
  Synthetic polypeptide
atgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctgcagtcaccatcatccagaccccccgggcctcagtttcctcaatcatagaagaagaccaatagacaagatcagct

SEQ ID NO: 2071 - DNA, 170 bp, Artificial Sequence
  Synthetic polypeptide
ggtgtttttccggcgccattacccactcaccaccctccgcttctgtggtatggaccctgagcaacggaagtggcagaagtactgcaaaccctcctgcagtcaccatcatccagaccccccgggcctcagtttcctcaatcatagaagaagaccaatagacaagatcagct

SEQ ID NO: 2072 - DNA, 410 bp, Artificial Sequence
  Synthetic polypeptide
atggatggccgagacttcgggccccagcggtccgtgcacggtcccccgccgccgctgctgtccggcctggccatggacagccaccgcgtgggcgcggccactgccggacgcttgcccgcctcgggcttgcccggcccgctgccgcccgggaagtacatggccggcctgaatctccatccgcacccgggcgaggccttcttgggcagctttgtggccagcgggatggggccctcggcctcgtcccatgggagcccagtgccactgccctctgacctgtctttccgctccccaacccctagcaacctgcccatggtgcagctgtgggccgcccacgcccatgaagcctgacaccccatgccacagaccaccttccagtcctcctccggctcagctcagagaccccctcttcc

SEQ ID NO: 2073 - DNA, 188 bp, Artificial Sequence
  Synthetic polypeptide
atggggccctcggcctcgtcccatgggagcccagtgccactgccctctgacctgtctttccgctccccaacccctagcaacctgcccatggtgcagctgtgggccgcccacgcccatgaagcctgacaccccatgccacagaccaccttccagtcctcctccggctcagctcagagaccccctcttcc

SEQ ID NO: 2074 - DNA, 47 bp, Artificial Sequence
  Synthetic polypeptide
atggaggacggcgtgctcaaggagggcttcctggtcaagaggtttct

SEQ ID NO: 2075 - DNA, 649 bp, Artificial Sequence
  Synthetic polypeptide
atgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtcactggtaccccagaccatgccacacctttattatgtgctctccattccccaccaaccgtgctcacctcagttgtgaattacatgttcatttctgcaggtctattttatcccataactgtccatcaagataagggcttgctcattactttacccccagcactcagcccaatgcctggcacatagtaggtgctcaataaa

SEQ ID NO: 2076 - DNA, 2153 bp, Artificial Sequence; identical to SEQ ID NO: 217
  Synthetic polypeptide

SEQ ID NO: 2077 - DNA, 1664 bp, Artificial Sequence; identical to SEQ ID NO: 222
  Synthetic polypeptide

SEQ ID NO: 2078 - DNA, 1766 bp, Artificial Sequence; identical to SEQ ID NO: 221
  Synthetic polypeptide

SEQ ID NO: 2079 - DNA, 2192 bp, Artificial Sequence
  Synthetic polypeptide
atgtctggaatcaagcgaaccatcaaagaaaccgaccctgattacgaggatgtatctgtggcccttccaaataagcggcataaagcaattgagaattcagctcgagatgctgctgtgcagaagattgagactattatcaaagaacagtttgctcttgaaatgaagaataaggaacatgaaattgaagtcattgaccagcgactgattgaagcaagaaggatgatggataaactgcgtgcctgcattgtagcaaactactatgcttctgcaggtcttctaaaagtttctgagggatcaaagacatgtgatacaatggtttttaatcatcctgctatcaagaaatttttggaatcaccatctaggtcatcatctcctgccaatcagagagcagaaacaccatcagccaatcattcagaaagtgattctttatctcagcacaatgacttcttatctgacaaagataataacagcaatatggatatagaggaaagactctcaaacaacatggagcagagaccaagccgaaatactggaagggatacttctagaattactggctcccataaaacagaacagcggaatgctgatctcacagatgagacttcacgactttttgtaaagaaaacaatagtagtgggcaatgtgtccaagtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttagagagcctccttttcacctgaccagaagaggctggggtgagtttcccgtcagagttcaagttcattttaaggacagccagaacaagcggatagatatcatacataatctgaaggaaaagaggaagtcaaattgtccctgtttgcagacgacatgattgtttatctagaaaaccccatcgtctcagcccaaaatctccttaagctgataagcaacttcagcaaagtctcaggatacaaaatcagtgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctagaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcacaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgttcatcatcactggtcatcagagaaatgcaaatcaaaaccactatgagatatcatctcacacc

SEQ ID NO: 2080 - DNA, 1430 bp, Artificial Sequence
  Synthetic polypeptide
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2081 - DNA, 1175 bp, Artificial Sequence
  Synthetic polypeptide
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2082 - DNA, 1418 bp, Artificial Sequence
  Synthetic polypeptide
atgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2083 - DNA, 1148 bp, Artificial Sequence
  Synthetic polypeptide
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2084 - DNA, 893 bp, Artificial Sequence
  Synthetic polypeptide
atgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2085 - DNA, 1136 bp, Artificial Sequence
  Synthetic polypeptide
atgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagatggtgtgacaatcattcagaaaatgtacaaagaagagttcggtaacctgaaatgttttatagttgggaggatttattgt

SEQ ID NO: 2086 - DNA, 1692 bp, Artificial Sequence; identical to SEQ ID NO: 1048
  Synthetic polypeptide

SEQ ID NO: 2087 - DNA, 1695 bp, Artificial Sequence; identical to SEQ ID NO: 1049
  Synthetic polypeptide

SEQ ID NO: 2088 - DNA, 466 bp, Artificial Sequence; identical to SEQ ID NO: 1050
  Synthetic polypeptide

SEQ ID NO: 2089 - DNA, 2474 bp, Artificial Sequence; identical to SEQ ID NO: 1065
  Synthetic polypeptide

SEQ ID NO: 2090 - DNA, 1694 bp, Artificial Sequence; identical to SEQ ID NO: 1066
  Synthetic polypeptide

SEQ ID NO: 2091 - DNA, 1361 bp, Artificial Sequence; identical to SEQ ID NO: 1067
  Synthetic polypeptide

SEQ ID NO: 2092 - DNA, 688 bp, Artificial Sequence; identical to SEQ ID NO: 1068
  Synthetic polypeptide

SEQ ID NO: 2093 - DNA, 531 bp, Artificial Sequence; identical to SEQ ID NO: 1069
  Synthetic polypeptide

SEQ ID NO: 2094 - DNA, 2055 bp, Artificial Sequence
  Synthetic polypeptide
atggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgatctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgttctccaccgacagccaggaaagaggaatgtcagccccgcaactacaaagaatgaaatctggccaacaacctggatgagcttggaagtggattcatccctagagcctccagaaagaaatgcagccctgccgacctgattgtggccttgggagatcctaatcaggggaccccgtgagccactctgtaccaggacttctgacctacagaaccgcgagagaataaattgctgttgttttaagcttctaaattgtggtgacttattatggtagcaatcaaaaatggataca

SEQ ID NO: 2095 - DNA, 2095 bp, Artificial Sequence
  Synthetic polypeptide
atgggttcagacaaaagagtgagtagaacagagcgtagtggaagatacggttccatcatagacagggatgaccgtgatgagcgtgaatcccgaagcaggcggagggactcagattacaaaagatctagtgatgatcggaggggtgatagatatgatgactaccgagactatgacagtccagagagagagcgtgaaagaaggaacagtgaccgatccgaagatggctaccattcagatggtgactatggtgagcacgactataggcatgacatcagtgacgagagggagagcaagaccatcatgctgcgcggccttcccatcaccatcacagagagcgatattcgagaaatgatggagtccttcgaaggccctcagcctgcggatgtgaggctgatgaagaggaaaacaggtgtaagccgtggtttcgccttcgtggagttttatcacttgcaagatgctaccagctggatggaagccaatcagaaaaagttggtgattcaaggaaagcacattgcaatgcattatagcaatcccagacctaagtttgaagattggctttgtaacaagtgctgccttaacaatttcaggaaaagactaaaatgcttccgatgtggagcagacaagtttgactctgaacaggaagtgcctcctggaaccacagagtcggttcagtctgtggattactactgtgatacgatcattcttcggaacatagctccgcacactgtggtggattccatcatgacagcactgtctccttacgcgtctttagctgtcaataacatccgcctcataaaagacaaacagacccagcagaacagaggcttcgcatttgtgcagctgtcctctgcaatggatgcttctcagctgcttcagatattacagagtctccatcctcctttgaaaattgatggcaaaactattggggttgattttgcaaaaagtgccagaaaagacttggtcctctcagatggtaaccgcgtcagcgctttctctgtagctagtacggctattgctgctgctcagtggtcatccacccagtctcaaagtggtgaaggaggcagtgttgactacagttatctgcaaccaggtcaagatggctatgcccaatatgctcagtattcacaggattatcagcagttttatcaacaacaagctggaggattggaatctgatgcatcatctgcatcaggcacagcagtgaccaccacctcagcggctgtagtgtcccagagtcctcagctgtataatcaaacctccaatccacctggctctccgactgaggaagcacagcctagcactagcacaagtacacaggccccagccgcttcccctactggtgtagttcctggtaccaaatatgcagtacctgacacgtccacttaccagtatgatgaatcttcaggatattactatgatccgacaacagggctctattatgaccccaactcgcaatactactataattccttgacccagcagtacctttactgggatggggaaaaagagacctacgtgccagctgcagagtctagctcccaccagcagtcgggcctgcctcctgcaaaagaggggaaagagaagaaggagaaacccaagagcaaaacagcccagcagattgccaaagacatggaacgctgggctaagagtttgaataagcagaaagaaaactttaaaaatagctttcagcctgtcaattccttgagggaagaagaaaggagagaatctgctgcagcagacgctggctttgctctctttgagaagaagggagccttagctgaaaggcagcagctcatcccagaattggtgcgaaatggagatgaggagaatcccctcaaaaggggtctggttgctgcttacagtggtgacagtgacaatgaggaggagctggtggagagacttgagagtgaggaagagaagctagctgactggaagaagatggcctgtctgctctgccggcgccagttcccgaacaaagatgccctagtcaggcaccagcaactctcagaccttcacaagcaaaacatggacatctatcgacgatccaggctgagcgagcaggagctggaagccttggagctaagggagagagaga

SEQ ID NO: 2096 - DNA, 1823 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2097 - DNA, 1859 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2098 - DNA, 1526 bp, Artificial Sequence
  Synthetic polypeptide
atggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2099 - DNA, 1685 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaattgccaaagatgaaaaaatatctgacaaaatcaagtgttgaaagaaagtgcaactttgctgttgggattttaaattgaaacaatggctctggaaaacaatctggcatcatctggtgaaactgaagatgcacatgcctaggatccagcaatctcactcctaggtaggtaacgccccagagaaacccttgcaacatgtgttccaggggacacacataagaatactcagagcagtaggaggaataacccaaatgtccatcaacagcagaatgggtaaatcggttgtgatatgcaatggaatg

SEQ ID NO: 2100 - DNA, 212 bp, Artificial Sequence
  Synthetic polypeptide
atggatacatactgaaatgtggatgaagtgataggtcaggaatttgcttcaaggatctgggagaggcagaagcatagatatgaatggctgctagttgatcattgaatctggatggttagtgtatgagattcattttatttactgttttgtctacttttgtgtatatttgaaattttccatgataaaatgttaaaataacaaatacaatgtgt

SEQ ID NO: 2101 - DNA, 938 bp, Artificial Sequence
  Synthetic polypeptide
atggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagaaagaagatgctgatatgctacaacacggatgaacctggaggacgtggtgcagtgaaataagctggtcacagagagacaaatcctgggtgatcccacttacatgaggtacctagagagccacattcatagagacaaagtagaatggtgggtcccaggggctggagggagtagaggaatcgggagccagtgttcgatggggacaaagtttcagtttctgggtcccaggggctggagggagtagaggaatcgggagccagtgttcgatggggacaaagtttcagtttcacaagacagatttctggacatggatgggggtgatggttgtgcaacattatgaacgtatttaatagcactgatctgtacacttataaatggctaagatg

SEQ ID NO: 2102 - DNA, 550 bp, Artificial Sequence
  Synthetic polypeptide
atgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtcactggtaccccagaccatgccacacctttattatgtgctctccattccccaccaaccgtgctcacctcagttgtgaattacatgttcatttctgcaggtctattttatcccataactgtccatcaagataagggcttgctcattactttacccccagcactcagcccaatgcctggcacatagtaggtgctcaataaa

SEQ ID NO: 2103 - DNA, 505 bp, Artificial Sequence
  Synthetic polypeptide
ggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtcactggtaccccagaccatgccacacctttattatgtgctctccattccccaccaaccgtgctcacctcagttgtgaattacatgttcatttctgcaggtctattttatcccataactgtccatcaagataagggcttgctcattactttacccccagcactcagcccaatgcctggcacatagtaggtgctcaataaa

SEQ ID NO: 2104 - DNA, 1032 bp, Artificial Sequence; identical to SEQ ID NO: 1790
  Synthetic polypeptide

SEQ ID NO: 2105 - DNA, 289 bp, Artificial Sequence; identical to SEQ ID NO: 1791
  Synthetic polypeptide

SEQ ID NO: 2106 - DNA, 1314 bp, Artificial Sequence; identical to SEQ ID NO: 1792
  Synthetic polypeptide

SEQ ID NO: 2107 - DNA, 620 bp, Artificial Sequence; identical to SEQ ID NO: 1793
  Synthetic polypeptide

SEQ ID NO: 2108 - DNA, 1736 bp, Artificial Sequence; identical to SEQ ID NO: 156
  Synthetic polypeptide

SEQ ID NO: 2109 - DNA, 1724 bp, Artificial Sequence; identical to SEQ ID NO: 157
  Synthetic polypeptide

SEQ ID NO: 2110 - DNA, 809 bp, Artificial Sequence
  Synthetic polypeptide
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2111 - DNA, 644 bp, Artificial Sequence
  Synthetic polypeptide
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2112 - DNA, 768 bp, Artificial Sequence
  Synthetic polypeptide
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2113 - DNA, 427 bp, Artificial Sequence
  Synthetic polypeptide
ggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagaatgtaagttccataaaggtaagaaccttctgttcttgtccaccaaggcctagaaaggtgggacacagagtaggcacttaaatattgattggctgaa

SEQ ID NO: 2114 - DNA, 1026 bp, Artificial Sequence
  Synthetic polypeptide
atgtggcagctctgggcctccctctgctgcctgctggtgttggccaatgcccggagcaggccctctttccatcccctgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagttttgagatcagccttggcaacacggtgaaaccccatctctactaaaaatacaaaattagccaagcatgctggcacatgcctgtaatcccagctactcgggaggctgaggtacgagaatcgcttgaacctgggaggcagaggatgcagtgagccgagatcacgccattgcactccagcctgggggacaagagtgaatctgtgtctcaccaaaaaaaaaaagaaaaagaaa

SEQ ID NO: 2115 - DNA, 721 bp, Artificial Sequence; identical to SEQ ID NO: 414
  Synthetic polypeptide

SEQ ID NO: 2116 - DNA, 627 bp, Artificial Sequence
  Synthetic polypeptide
atgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctgcgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaaccaggtttcagaaccgctg

SEQ ID NO: 2117 - DNA, 3723 bp, Artificial Sequence; identical to SEQ ID NO: 1743
  Synthetic polypeptide

SEQ ID NO: 2118 - DNA, 3708 bp, Artificial Sequence; identical to SEQ ID NO: 1744
  Synthetic polypeptide

SEQ ID NO: 2119 - DNA, 3333 bp, Artificial Sequence; identical to SEQ ID NO: 1745
  Synthetic polypeptide

SEQ ID NO: 2120 - DNA, 335 bp, Artificial Sequence
  Synthetic polypeptide
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagggaacctggggaaaaatcagaaagaacctagagtgag

SEQ ID NO: 2121 - DNA, 578 bp, Artificial Sequence
  Synthetic polypeptide
atggcctggtggaaatcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2122 - DNA, 635 bp, Artificial Sequence
  Synthetic polypeptide
atggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2123 - DNA, 449 bp, Artificial Sequence
  Synthetic polypeptide
atggcctggtggaaatcctgggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2124 - DNA, 1714 bp, Artificial Sequence
  Synthetic polypeptide
atgcccgggatcgtggtgttccggcggcgctggtctgtgggcagtgatgacctcgtcctaccggccatcttcctctttctcctgcataccacctggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctggccatcctggtgatcgagttcatctacgccatcgtgggcatcgtctggctcactcagtactacacctcctgcaacgacctcactgccaagaatgtcaccctcggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggcaccgcttagaggagggtcaagccaccagctggtcgcgccggctcaaagtgttcctctgctgcacgcggacgaaggactcccagtcagatgcctactcagaaatcgcctacctctttgcggagttcttccgggaccttgacattgtgccatccgacatcattgctggcctggtgctgctccggcagcggcagcgggccaagcgcaacgccgtgctggacgaggcaaacaatgacatcttggccttcctgtctgggatgccggtgaccagaaacaccaagtacctcgacctcaagaattcacaagagatgctccgctacaaagaggtctgctactacatgctctttgccctggctgcctacgggtggcccatgtacctgatgcggaagcccgcctgcggcctctgccaactggctcggtcctgctcgtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtctatgaaacgcccttctacgtggcggtggaccatgacaagaagaaagtggtgatcagtatccgggggaccctgtcccccaaggatgccctgactgacctgacgggtgatgctgagcgcctccccgtggaggggcaccacggcacctggctgggccacaagggtatggtcctctcagctgagtacatcaagaagaaactggagcaggagatggtcctgtcccaggcctttgggcgagacctgggccgcggaaccaaacactacggcctgattgtggtgggccactccctgggcgcgggcactgctgccatcctctccttccttctgcgcccacagtatccgaccctcaagtgctttgcctactccccgccagggggcctgctgagtgaggatgcgatggagtattccaaggagttcgtgactgctgtggttctgggcaaagacctcgtccccaggattggcctctctcagctggaaggcttccgcagacagctcctggatgtcctgcagcgaagcaccaagcccaaaatgaggggttggctgggcttccagccccttgccagccctgaaattcaacaattccatg

SEQ ID NO: 2125 - DNA, 182 bp, Artificial Sequence
  Synthetic polypeptide
atgggcaacacggtgcaccggaccctgccagagagcgccttcgctgacacgctgacgcccgcgcgcctcagccaggcccgcttcagcgcctgcctgccgcccagcagccacgacgcggccaacttcgacaacaacgagctcgagaacaaccagaatgtgtgtgtgagagagagagagagaga

SEQ ID NO: 2126 - DNA, 728 bp, Artificial Sequence
  Synthetic polypeptide
atgggcaacacggtgcaccggaccctgccagacccgagcccaccggcgcgcctcctggccacccggccgtgctgcggccccggccccgagcgacgcccggtcctgggcgaggcgccgcgcttccacgcgcaggccaaaggcaagaacgtgcggctggacggccactcgcgccgggccacacggcgcaacagcttctgcaatggcgtcacgttcacgcagcggcccatccggctgtacgagcaggtgcggctgcgcctggtggccgtgcgccctggctggagcggcgcgctgcgcttcggcttcaccgcgcacgatccgtcgctcatgagcgcccaggacatccccaagtacgcctgcccggacctggtcacgcggccgggctactgggccaaggcactgcccgagaacctggcgctgcgcgacacggtgctggcctactgggccgaccgccacggccgcgtgttctacagcgtgaacgacggcgagccggtgctcttccactgcggcgtggccgtgggcggcccgctctgggcgctcattgatgtctacggcatcaccgacgaggtgcagcttctggagagcgccttcgctgacacgctgacgcccgcgcgcctcagccaggcccgcttcagcgcctgcctgccgcccagcagccacgacgcggccaacttcgacaacaacgagctcgagaacaaccagaatgtgtgtgtgagagagagagagagaga

SEQ ID NO: 2127 - DNA, 2849 bp, Artificial Sequence; identical to SEQ ID NO: 1326
  Synthetic polypeptide

SEQ ID NO: 2128 - DNA, 1925 bp, Artificial Sequence; identical to SEQ ID NO: 1327
  Synthetic polypeptide

SEQ ID NO: 2129 - DNA, 2729 bp, Artificial Sequence; identical to SEQ ID NO: 1328
  Synthetic polypeptide

SEQ ID NO: 2130 - DNA, 2549 bp, Artificial Sequence; identical to SEQ ID NO: 1329
  Synthetic polypeptide

SEQ ID NO: 2131 - DNA, 1093 bp, Artificial Sequence
  Synthetic polypeptide
atgcatgaaaggttcatccattgcttctgtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaaga

SEQ ID NO: 2132 - DNA, 1234 bp, Artificial Sequence
  Synthetic polypeptide
atgtcactgcatcagtttttactagagccaatcacctgtcatgcctggaacagggatcgtactcagattgccctcagtcccaataatcacgaagtgcacatctataagaagaacgggagccagtgggtgaaagctcatgaactcaaggagcacaacggacacatcacaggtattgactgggctcccaagagcgaccgcattgtcacttgtggggcagaccgcaatgcctatgtctggagtcagaaagatggtgtttggaagccaaccctggtgatcctgagaattaatcgcgcagctacttttgtgaagtggtcccccctagagaacaaatttgctgtgggaagtggagcacgactcatttctgtttgttactttgagtctgaaaatgactggtgggtgagcaagcacattaaaaagccgattcgctccacagtcctcagcttggattggcatcccaacaacgttttgctggcagcaggatcatgtgacttcaaatgcagagtgttttctgcctacattaaagaagtggatgaaaagccagccagcacgccctggggcagcaagatgccttttgggcagctgatgtcagagtttggtggcagtggcactggtggctgggtccacggggtaagcttctctgccagtgggagccgcctggcctgggtcagccacgacagcaccgtgtctgttgctgatgcctcaaaaagtgtgcaggtctcgactctgaagacagagttcctgccgctcctaagtgtgtcatttgtctcagagaacagcgtcgtggctgctggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcactcaagtctctatttatgaggtggacaagcaagattgtcgcaaattttgcactactggcatcgatggagccatgacaatttgggatttcaaggtgcagtgacgcatgcctttagttgcagctacttgagaagctgaggcaggaggatcacttgagcccaggagttggaggctgcagtgagctgtggtcacaccactgcactccagcctggggcaacagagcaagaccctatctttaaaaaaaaaaaaaaaga

SEQ ID NO: 2133 - DNA, 258 bp, Artificial Sequence; identical to SEQ ID NO: 265
  Synthetic polypeptide

SEQ ID NO: 2134 - DNA, 243 bp, Artificial Sequence; identical to SEQ ID NO: 267
  Synthetic polypeptide

SEQ ID NO: 2135 - DNA, 324 bp, Artificial Sequence; identical to SEQ ID NO: 268
  Synthetic polypeptide

SEQ ID NO: 2136 - DNA, 1791 bp, Artificial Sequence
  Synthetic polypeptide
atgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggcacagtggctcacgccagtaatcccagcactttgggaggccgaggcaggaggatcacttgagcccaggaatctgagaccagcttgagcaatatggcaaaaccctgtcgctacaaaaattacccaggtgtggtggagcacacctgtagtcccaggtacttgggagcctgaggcagcagaatcacttgaacccaggaggtctttgaggctgcagtgagccatgatcacaccactgcactccttcctagaccaaagaatgagaccctgtctaaaaaaaataaaataaaataa

SEQ ID NO: 2137 - DNA, 466 bp, Artificial Sequence
  Synthetic polypeptide
atgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagttttactggcata

SEQ ID NO: 2138 - DNA, 644 bp, Artificial Sequence
  Synthetic polypeptide
atgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaggtaggaggacaggagccatggtgcctagaacaaagcagctcctcagtaaacatttgttgaatgaa

SEQ ID NO: 2139 - DNA, 255 bp, Artificial Sequence
  Synthetic polypeptide
ggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaaggaggtaggaggacaggagccatggtgcctagaacaaagcagctcctcagtaaacatttgttgaatgaa

SEQ ID NO: 2140 - DNA, 2365 bp, Artificial Sequence
  Synthetic polypeptide
atggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtatgctctgctggatccagagggaggactgcttccaccagaagacacagttgaactaaattccattgaactagaagttaagactgccatccaaccactttgggctccttatgcctctgagtcaacaggccaataggggagttatggtgttggctggggtaattgatccagactaccatggggaaatctgacataaaagaggtaaaaaagaatatgtctggaacacaggagatctcttagggtgtctcagtattaccatgccctgtggttaaagtcaatggaaaactacaacccaaaccaggcaagactatgaatggcccagacctttaggaatgaaggtttggtttacctcccctccaccctcaaaccaaccttggccttctaggttaagaagcataaccagctgaggttcttgctgaaggcaaagggaatacaggatgggtagttgaagatggtagttgtaagtatgagctgcagccatgtcatcagttacagaaaagaagactgtaattgtcatgaatatttcatccctattttttttaaataatgtgtgtatgtacacatatattaaacaaatatctttgtttcctttcctttcttatcccttatcgtgtaacataagatgtattgactttatactagtattctaagtactagtattgttaatactttaaagacatcttagtattttaagtatgggatatcagaagactacacgtcactcacagactttacctcctcttctggaaaagggattactgcattttttgttgtatgcaggatagttgtatcatgttaagtggaattatgaccttgttattgtcattatttggagattaactatggtttaaggagatacatatggatgccaagttcacaaggggcagact

SEQ ID NO: 2141 - DNA, 257 bp, Artificial Sequence
  Synthetic polypeptide
gcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2142 - DNA, 1778 bp, Artificial Sequence
  Synthetic polypeptide
atgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2143 - DNA, 2021 bp, Artificial Sequence
  Synthetic polypeptide
atgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2144 - DNA, 1175 bp, Artificial Sequence
  Synthetic polypeptide
atggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggaggttgcagtgagctgagatcgcgccattgtactccagcctgggcaacaagagcgaaactctgtctcaacaacaacaaaaa

SEQ ID NO: 2145 - DNA, 1839 bp, Artificial Sequence; identical to SEQ ID NO: 1059
  Synthetic polypeptide

SEQ ID NO: 2146 - DNA, 1400 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaatcgcttgaacccgggaggtggagattgcagtgagcccagatcgcaccactgcactccagtctggcaacagagcaagactccatctcaaaaagaaaagaaaagaa

SEQ ID NO: 2147 - DNA, 1403 bp, Artificial Sequence
  Synthetic polypeptide
atggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacaaattaagtgttgaccacagcgacccagtcatcctgaatgtcctctatggcccagacgaccccaccatttccccctcatacacctattaccgtccaggggcaggagaatcgcttgaacccgggaggtggagattgcagtgagcccagatcgcaccactgcactccagtctggcaacagagcaagactccatctcaaaaagaaaagaaaagaa

SEQ ID NO: 2148 - DNA, 755 bp, Artificial Sequence
  Synthetic polypeptide
atgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2149 - DNA, 290 bp, Artificial Sequence
  Synthetic polypeptide
atgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2150 - DNA, 800 bp, Artificial Sequence
  Synthetic polypeptide
atgattcttcaagaaaccaaagcagcctgtggcattccagcgattcctcattgctcaagggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2151 - DNA, 281 bp, Artificial Sequence
  Synthetic polypeptide
agacgctcttcgtgcaccgcttctcccatggcactatgcctttgcgcaacatcttcaagaactgcacctactactggggcttcgccgcgtggatggcctattacatcaatcaccctctctacactccccctaatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggc

SEQ ID NO: 2152 - DNA, 1838 bp, Artificial Sequence
  Synthetic polypeptide
atggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggggg

SEQ ID NO: 2153 - DNA, 586 bp, Artificial Sequence; identical to SEQ ID NO: 401
  Synthetic polypeptide

SEQ ID NO: 2154 - DNA, 829 bp, Artificial Sequence; identical to SEQ ID NO: 402
  Synthetic polypeptide

SEQ ID NO: 2155 - DNA, 1060 bp, Artificial Sequence; identical to SEQ ID NO: 403
  Synthetic polypeptide

SEQ ID NO: 2156 - DNA, 730 bp, Artificial Sequence; identical to SEQ ID NO: 406
  Synthetic polypeptide

SEQ ID NO: 2157 - DNA, 496 bp, Artificial Sequence; identical to SEQ ID NO: 408
  Synthetic polypeptide

SEQ ID NO: 2158 - DNA, 121 bp, Artificial Sequence
  Synthetic polypeptide
atgaagaagtcttactcaggaggcacgcggacctccagtggccggctccggaggcttggtgactccagtggcccagccccacagctgtggtccattatggcagccacaggacactgatgca

SEQ ID NO: 2159 - DNA, 1142 bp, Artificial Sequence
  Synthetic polypeptide
atgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaagaagaa

SEQ ID NO: 2160 - DNA, 1041 bp, Artificial Sequence
  Synthetic polypeptide
atggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2161 - DNA, 987 bp, Artificial Sequence
  Synthetic polypeptide
atggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2162 - DNA, 1089 bp, Artificial Sequence
  Synthetic polypeptide
atgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2163 - DNA, 678 bp, Artificial Sequence
  Synthetic polypeptide
atgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagcttgcagtgagccgagatatcgccactgcactccagcctgggtgacagagcgagactccatctcaaaaaaaaaaaaaaaaagaa

SEQ ID NO: 2164 - DNA, 1277 bp, Artificial Sequence
  Synthetic polypeptide
atggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2165 - DNA, 1223 bp, Artificial Sequence
  Synthetic polypeptide
atggagggagctgctttgctgagagtctctgtcctctgcatctgggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2166 - DNA, 1325 bp, Artificial Sequence
  Synthetic polypeptide
atgagattcaaaagccacactgtggaattgaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2167 - DNA, 914 bp, Artificial Sequence
  Synthetic polypeptide
atgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaagctggacttgttcgagtcattctttggtctctcagctctttccaagctttgggggccatcagtctcaagtttttctcgtaa

SEQ ID NO: 2168 - DNA, 199 bp, Artificial Sequence
  Synthetic polypeptide
atggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatccccatctgaaaaacctcttgcacatggacaaacatttattggaggaatgaa

SEQ ID NO: 2169 - DNA, 578 bp, Artificial Sequence
  Synthetic polypeptide
atggcctggtggaaatcctggattgaacaggagggtgtcacagtgaagagcagctcccacttcaacccagaccctgatgcagagaccctctaccaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2170 - DNA, 635 bp, Artificial Sequence
  Synthetic polypeptide
atggcctggtggaaatcctggattgaacaggagggtgtcacagtgaagagcagctcccacttcaacccagaccctgatgcagagaccctctaccaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccaggactggccctccaagacgcacaggttatacagaccccagccccattcccatctactgaaacagggtctccacaagaggggccagggaatatgggtttttaacaagc

SEQ ID NO: 2171 - DNA, 449 bp, Artificial Sequence; identical to SEQ ID NO: 2123
  Synthetic polypeptide

SEQ ID NO: 2172 - DNA, 186 bp, Artificial Sequence
  Synthetic polypeptide
atggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaagatgcgatataaaggtgtaattattatt

SEQ ID NO: 2173 - DNA, 1273 bp, Artificial Sequence
  Synthetic polypeptide
atgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggcagatcacctgagcaggagttcgagaccagcctggccaacatggtgaaaccccgtgaacactaaaaatacaaaaaattagccaggcgtggtggtgcatgcctgtaatcccagctactcaggaggctgaggcaggagaatcacttgaacccgggagggagaggttgcagtgaaccgagatcatgccactgcaccccagcctgggcaagaagaaggaaactcctcctcaaaaaaaaaaaaaaaaa

SEQ ID NO: 2174 - DNA, 1091 bp, Artificial Sequence
  Synthetic polypeptide
atgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgataaagtgtgttgttatgaggattcaatgaggagacctgtatgaagtgccttcccctgtgcctggctcatagtaagtgttcagtgagttttggt

SEQ ID NO: 2175 - DNA, 677 bp, Artificial Sequence
  Synthetic polypeptide
atggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggccaggtgtggtggttcacgcctgtaatcccagcacttttggaggctgaggagggcggatcacctgaggtcgtgagttcaagaccagcctggccaacatggtgaaaccccatctctactgaaaacacaaaaattagctgggtgtggtggtgcacgcctgtaatcccatatactccagaggctgaggcatgagaatcacctcaactcgggagccgagatcgcaccactgcactccagcctaagcaacagaagactgtctaaaaaaaaaagaaaaaagaaaagaaaagaaa

SEQ ID NO: 2176 - DNA, 563 bp, Artificial Sequence
  Synthetic polypeptide
atggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2177 - DNA, 980 bp, Artificial Sequence
  Synthetic polypeptide
atgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2178 - DNA, 929 bp, Artificial Sequence
  Synthetic polypeptide
atgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2179 - DNA, 1205 bp, Artificial Sequence
  Synthetic polypeptide
atgaagcgggaccggctgggccgcttcctgtctcctgggtcgtcccgacagtgcggggcctcggacggcggcggcggcgtcagccggactcggggccgcccttcccttagcggtgggccgagggtggacggggcgacggcgcggcgcgcctggggcccggtggggtcctgcggggacgcgggcgaggacggcgcggacgaggcaggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaccctatacccagcagtacccagaacactcccaggta

SEQ ID NO: 2180 - DNA, 2572 bp, Artificial Sequence; identical to SEQ ID NO: 1541
  Synthetic polypeptide

SEQ ID NO: 2181 - DNA, 2407 bp, Artificial Sequence; identical to SEQ ID NO: 1542
  Synthetic polypeptide

SEQ ID NO: 2182 - DNA, 651 bp, Artificial Sequence; identical to SEQ ID NO: 1543
  Synthetic polypeptide

SEQ ID NO: 2183 - DNA, 391 bp, Artificial Sequence; identical to SEQ ID NO: 1544
  Synthetic polypeptide

SEQ ID NO: 2184 - DNA, 847 bp, Artificial Sequence; identical to SEQ ID NO: 1423
  Synthetic polypeptide

SEQ ID NO: 2185 - DNA, 793 bp, Artificial Sequence; identical to SEQ ID NO: 1424
  Synthetic polypeptide

SEQ ID NO: 2186 - DNA, 418 bp, Artificial Sequence; identical to SEQ ID NO: 1425
  Synthetic polypeptide

SEQ ID NO: 2187 - DNA, 798 bp, Artificial Sequence; identical to SEQ ID NO: 1426
  Synthetic polypeptide

SEQ ID NO: 2188 - DNA, 1638 bp, Artificial Sequence
  Synthetic polypeptide
atgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtattagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggcacggtggctcatgcctgtaatcacagcactttggaagtccgaggtgggtggatcacctgaggtcaagagttcgagaccagcctggccaacatggcgaaaccctgtctctgctaaaaatgcaagaattagccatgtgtggtggtgggcgcctataatcccagctactcagaaggctgaggcaggagaatcgcttgaacccgggaagcggaagttgcagtgagccaagtttgtgttattgcactccagcttgggcaagagtgaaactgtcttaaaaaaaaaaaaaaaaaaa

SEQ ID NO: 2189 - DNA, 578 bp, Artificial Sequence
  Synthetic polypeptide
atggcctggtggaaagcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcagcagggatgatgtgagcagctttgtggacccggcactggccctccaagacgcacaggttatacagaccccagccccattcccatctactgaaacagggtctccacaagaggggccagggaatatgggtttttaacaagc

SEQ ID NO: 2190 - DNA, 635 bp, Artificial Sequence
  Synthetic polypeptide
atggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggttatacagaccccagccccattcccatctactgaaacagggtctccacaagaggggccagggaatatgggtttttaacaagc

SEQ ID NO: 2191 - DNA, 449 bp, Artificial Sequence
  Synthetic polypeptide
atggcctggtggaaagcctgggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggttatacagaccccagccccattcccatctactgaaacagggtctccacaagaggggccagggaatatgggtttttaacaagc

SEQ ID NO: 2192 - DNA, 980 bp, Artificial Sequence; identical to SEQ ID NO: 139
  Synthetic polypeptide

SEQ ID NO: 2193 - DNA, 1256 bp, Artificial Sequence; identical to SEQ ID NO: 140
  Synthetic polypeptide

SEQ ID NO: 2194 - DNA, 1277 bp, Artificial Sequence; identical to SEQ ID NO: 142
  Synthetic polypeptide

SEQ ID NO: 2195 - DNA, 665 bp, Artificial Sequence
  Synthetic polypeptide
atgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggctgtgccagctctcctgtccaggcatgagtgcccagagacctaga

SEQ ID NO: 2196 - DNA, 2344 bp, Artificial Sequence
  Synthetic polypeptide
atgtcaagttcaggttatcctcccaaccaaggagcattcagcacagaacaaagtcgttatcctcctcactctgtccagtatacatttcccaacacccgccaccagcaggagttcgcagtccctgattatcgttcctctcatcttgaagtgagtcaggcatcacagcttttgcagcaacagcagcagcaacagcttcgaaggcgaccttccttgctttcagaatttcacccaggttctgacaggcctcaagaaaggagaactagttatgaaccgtttcatccaggcccatccccagtggatcatgattcactggaatcgaagcgaccacgtctggaacaggtttctgattctcattttcagcgtgtcagtgctgcggttttgcctttagtgcacccgctgccagaagggctgagggcttctgcagatgctaagaaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggaaaaaaaaagatactcatgtttggctactgcttggtgaaacattatgccttggaaaccttcctactcttttgtggcttggaagaagaaaattggaaaagtgcttatgtcaaatgatatcatctgctgtataaccactaacatgtcttctaatattttgaag

SEQ ID NO: 2197 - DNA, 2017 bp, Artificial Sequence
  Synthetic polypeptide
atgtcaagttcaggttatcctcccaaccaaggagcattcagcacagaacaaagtcgttatcctcctcactctgtccagtatacatttcccaacacccgccaccagcaggatccagcattcggaggcaaacatgaagctccatcctctccaatttcggggcaaccatgtggagatgatcaaaatgcttcaccttcaaaactctcaaaggaagagttaatacagagtatggatcgtgtagatcgagaaattgcaaaagtagaacagcagatccttaaactgaaaaagaaacaacaacagcttgaagaagaggcagctaaacctcctgagcctgagaagcccgtgtcccctcctcctgtggagcagaaacaccgcagtattgtccaaattatttatgatgagaatcggaaaaaagcagaagaagctcataaaatttttgaaggtcttggcccaaaagttgaactgccactgtataaccagccatcagataccaaggtgtaccatgagaacatcaagacaaaccaggtgatgaggaaaaaactcattttattttttaaaagaagaaatcatgcaagaaaacaaagggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcgagttgggcagaggggagctggtctttcagccaccattgctaggagtgagcatgagatttctgaaattattgatgggctctctgagcaggagaataatgagaaacaaatgcggcagctctctgtgattccacctatgatgtttgatgcagaacaaagacgagtcaagttcattaacatgaatgggcttatggaggaccctatgaaagtgtataaagataggcagtttatgaatgtttggactgaccatgaaaaggagatctttaaggacaagtttatccagcatccaaaaaactttggactaattgcatcatacttggagaggaagagtgttcctgattgtgttttgtattactatttaaccaagaaaaatgagaattataaagccctcgtcagaaggaattatgggaaacgcagaggcagaaaccagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaaagaaaataccaaggaaaaggacaagatagatggtacagcagaagaaactgaggaaagagagcaagccacaccccgggggcgaaagactgccaacagtcagggccgccgtaagggccggatcaccaggtccatgacaaacgaagctgcagctgccagtgctgcagccgcagcggctactgaagagcccccaccacctctgccaccgccaccagaacccatttctacagagcctgtggagacctctcgatggacagaagaagaaatggaagttgctaaaaaaggtctagtagaacatggtcgtaactgggcagcaattgctaaaatggtgggaacgaaaagtgaagctcaatgtaaaaacttctattttaactataaaaggcgacacaatcttgacaacctcttacagcagcataaacagaaaacttcacgaaaacctcgtgaagagcgagatgtgtctcaatgtgaaagtgtcgcttccactgtttctgctcaggaggatgaagatattgaagcctccaatgaagaagaaaatccagaagacagcgaaggaaaaaaaaagatactcatgtttggctactgcttggtgaaacattatgccttggaaaccttcctactcttttgtggcttggaagaagaaaattggaaaagtgcttatgtcaaatgatatcatctgctgtataaccactaacatgtcttctaatattttgaag

SEQ ID NO: 2198 - DNA, 763 bp, Artificial Sequence; identical to SEQ ID NO: 261
  Synthetic polypeptide

SEQ ID NO: 2199 - DNA, 646 bp, Artificial Sequence; identical to SEQ ID NO: 262
  Synthetic polypeptide

SEQ ID NO: 2200 - DNA, 1372 bp, Artificial Sequence; identical to SEQ ID NO: 1756
  Synthetic polypeptide

SEQ ID NO: 2201 - DNA, 1166 bp, Artificial Sequence
  Synthetic polypeptide
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccagagacagggagagacagagagagatagagagacagagatagagacagagatacagagacacagagaaagacagagagagatagagacagagagatacagagagacagagaaagagatagagagacagagatagagacagaaagacagagatagagatagagatgaaagacagagatacagagagacagagaaagacagagagatagacatgagagagacagagatagagatacagagagacagaaagagagatagagacagagcgatagagataagagaaaga

SEQ ID NO: 2202 - DNA, 1061 bp, Artificial Sequence
  Synthetic polypeptide
gcctccaccaagggcccatcggtcttccccctggcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccagagacagggagagacagagagagatagagagacagagatagagacagagatacagagacacagagaaagacagagagagatagagacagagagatacagagagacagagaaagagatagagagacagagatagagacagaaagacagagatagagatagagatgaaagacagagatacagagagacagagaaagacagagagatagacatgagagagacagagatagagatacagagagacagaaagagagatagagacagagcgatagagataagagaaaga

SEQ ID NO: 2203 - DNA, 24 bp, Artificial Sequence
  Synthetic polypeptide
atggaagccttccctgactgccta

SEQ ID NO: 2204 - DNA, 965 bp, Artificial Sequence; identical to SEQ ID NO: 1615
  Synthetic polypeptide

SEQ ID NO: 2205 - DNA, 843 bp, Artificial Sequence
  Synthetic polypeptide
atgtcgaaccccgggacacgcaggaacggctccagcatcaagatccgtctgacagaatttgacaagctgattaaaatttatctggaaatgcaagagatctagaatagctcaaacagtcctgaaaaaacaacaacaaagttggagactagcacttctcaatttcaaaacttactacaaagctaaagtaattacgacagaatggtactgacagtagcgtagatatagaggtcaatagaatagacttcggaatccagaaataagtcctcatatttatggtcagttgattttcaacagtgatgacaagataatttgacaggggaaataatagtcttttcaacaaatggtcctggaacaagtggatatacacatgtaaaagaatgaaattgagctcctacctcaagaactcctaggagaaaacaggaataaatcttcaatactttggtctagacatggaatcttagatatgacaaacaaagcacaggcaacaaaaggaaaacagattaattggatttcatcaaaattcaaagcttctgtgcttcaaaggactcttgaagaaaaagaaaactcacagcatgggagaaaatgtttgcaaattatgtttgaaaagggtcttgtctctaaaatatataaagaacccttacaactccacaatgaaaaacaaataactcagtttaatacatgggtaaaggatctgaacagacatttctccaaagaaggctaccaacatggccaataagcccatgaaaagatgctcagcatcaaagtctcagagacatgccaatcaaaaccgtggtgagataccccgtagactcactagatggctaaaattaaaaaatgcgatca

SEQ ID NO: 2206 - DNA, 446 bp, Artificial Sequence
  Synthetic polypeptide
atgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagctccagaacagctccagagtgataaaggtgaaagacagtcttttgtt

SEQ ID NO: 2207 - DNA, 206 bp, Artificial Sequence
  Synthetic polypeptide
atggtgcttcagccaagtgaaaggcactatcgagattggaaccacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2208 - DNA, 244 bp, Artificial Sequence
  Synthetic polypeptide
atgatacctggaattgggacactcacccaggacacactatggtgcttcagccaagtgaaaggcactatcgagattggaaccacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2209 - DNA, 229 bp, Artificial Sequence
  Synthetic polypeptide
atggcggcgcctttgaggattcagagcgactgggcgcaagccctcaggaaggatgaaggggaggcctggctgagctgtcatcccccagcctgaggctctcatcagaagcagatgctggtgccatgcttcttgtacagtctgcagaaccgtgagccaaataaacctcttttctttataaattacccagcctcaggtattcctttatagcaacactaaacagactaagaca

SEQ ID NO: 2210 - DNA, 499 bp, Artificial Sequence
  Synthetic polypeptide
atggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggaagtggtctttggatggaaagtttgagaaccactg

SEQ ID NO: 2211 - DNA, 1563 bp, Artificial Sequence; identical to SEQ ID NO: 2008
  Synthetic polypeptide

SEQ ID NO: 2212 - DNA, 802 bp, Artificial Sequence
  Synthetic polypeptide
ggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2213 - DNA, 2141 bp, Artificial Sequence
  Synthetic polypeptide
atgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2214 - DNA, 2192 bp, Artificial Sequence
  Synthetic polypeptide
atgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtcaggcaacgaactccctctggcagtggcttctactgctgacctgatacgctgtaagctcttggatgtaactggtggcttgggcactgatgaacttagactgctctatggcatggcattggtcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagatggtcagactgaggtccagagaggggaaggtactgacccaaagtcacacaaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2215 - DNA, 2015 bp, Artificial Sequence
  Synthetic polypeptide
atgtcgtgggaatccggggccgggccaggtctaggttcccaggggatggatctcgtgtggagtgcgtggtacggaaagtgcgttaaagggaaagggtcgttgccactctcggcccacggcatcgtggtcgcctggctcagcagggccgagtgggaccaggtgacggtttatctgttctgtgacgaccataagttgcagcggtacgcgcttaaccgcatcacggtgtggaggagcaggtttgtgaatcttatctcagagaggaagacaaagtttgccaaggtccccctcaagtgtctggctcaagaggtaaatattccggattggattgttgaccttcgccatgagttgacccacaagaaaatgccccatataaatgactgccgcagaggctgctactttgtcctggattggctccagaagacctattggtgccgccaactggagaacagcctgagagagacctgggagttggaggagttcagggaagggatagaggaagaggatcaagaggaagataagaacattgttgttgatgacatcacagaacagaaaccagagcctcaggatgatgggaaaagtacggagtcagatgtaaaggccgatggagacagcaaaggcagcgaagaggtggattctcattgcaaaaaggccctgagtcataaagagctatatgaaagagcccgagaactgctggtatcatacgaagaggagcagtttacggtgctggagaaatttaggtatttacctaaggccattaaggcgtggaataacccgtccccacgtgtagaatgtgtcctggcagagctcaagggcgttacatgcgagaacagggaggctgtgctggatgcttttctggatgatggcttccttgtccccacatttgaacagttggcagctttgcagatagaatatgaagaaaacgtggacttgaatgacgtcctggtgccaaagccgttctctcagttctggcagcccctgctcaggggcctgcactcccagaacttcacgcaggccctattggagaggatgctctctgaactgccagccttggggatcagcgggatccggcctacctacatcctcagatggaccgttgaactgatcgtggccaacaccaagactggacggaatgctcgccgattttctgcaggccagtgggaagcaagaaggggctggaggctgttcaactgctccgcctcccttgactggccccggatggttgagtcctgcttgggctcaccttgctgggccagcccccaactccttcggatcccgggtagctgagctctgctggagaaaaccacatagccctgcggattgctgccactgcagaggtatgatttttaatctcgggcgaggcctcagttctgcttgtctgaacttttacttgttttctgaccactttctctcccatttcctcactattctaaacccttaccgctcacctcaagcccctccccctctcccatttcaccctagcttcctcgagcacatggaggcatccggcagggccccctcgacctgaggtccagccctcgtgaactgatctgcggctgcactcaaccttctcgccagtctcaggatgaggtggccttgccccacctcaaagcctgctcctccacctgtgctctggagccacctctgccagcatcgctggggcctcaccccagcctctaccttgctctgctggctcttgctcttcaacctaggaacgtgcctgagcttttctcatcttaaacaaaacaacaataacagcaacacaagcaaaatctcctttgaccctgcatccctctgttgggttatcatcagcttatcattcccacccttcccatcaaaacatctcaaaagagtagtctacactcaacactctccatttcctcactaccctcttactcctcaacctgctgcaatttgacattcacccccagagttgctttgacctcctaattaccaaatcagtgggcccttgtcagtctctgtgtctgctgcattgatgctgtttaccaccccctcct

SEQ ID NO: 2216 - DNA, 3391 bp, Artificial Sequence
  Synthetic polypeptide
atgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgagactaaacaccagcgagcagagctcagctatctagttgacagacctcgccgagttaacagttctgcattccaggaagccgacatagtaagctctaaggacagtggtcatggagacagtgaacagggagatagtgatcatgatgccaccaaccgtgcccagtcagctggtatggatctcttctccaattgcactgaggaatgtaaagctctgggccactcagatcggtgctggatgccttcttttgtcccttctgatggacgccaggctgctgattatcgcagcaatctgcatgttcctggcatggactctgttccagacactgaggtgtttgaaactccagaagcccagcctggggcagagcggtccttttccacctttggcaaagagaaggcccttcacagcactctggagaggaaggagctggatggactgctgactaatacgcgagcgccttacaaaccaccatatttgaagctattgtggaggcagctatgtggagagacacatgtggcacaagatcaagggctgtcaacaaccacatgagtgagcttggaaacagactcccaagttgagcattcagatgagaccacagcccctgctgacagtttgactgcaacctttgagagtccttagccagaggcacccagttaagctgcactaaaatttttgaaccacacagattgtgagataataaatatttgtggttttatgttgtgaggttttggggtatattgccatgtggcaataaatagttaataca

SEQ ID NO: 2217 - DNA, 1825 bp, Artificial Sequence; identical to SEQ ID NO: 1660
  Synthetic polypeptide

SEQ ID NO: 2218 - DNA, 1825 bp, Artificial Sequence; identical to SEQ ID NO: 1661
  Synthetic polypeptide

SEQ ID NO: 2219 - DNA, 410 bp, Artificial Sequence
  Synthetic polypeptide
atgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagactgggcgcagctcgattccgactcatctctgtttccttaacgcccaggcgtaggtgggcccaggcgcgtgctgagcgagtgagtgtgtgagcggatgga

SEQ ID NO: 2220 - DNA, 392 bp, Artificial Sequence
  Synthetic polypeptide
atggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagactgggcgcagctcgattccgactcatctctgtttccttaacgcccaggcgtaggtgggcccaggcgcgtgctgagcgagtgagtgtgtgagcggatgga

SEQ ID NO: 2221 - DNA, 1063 bp, Artificial Sequence
  Synthetic polypeptide
atgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacggtaaccgaacctgtctgcgcctcagtttacccatcagtaaagtggaaataaacaatagcacctatataacaaggctgttgtgaagattatgtgaactaaatatgtaaggtggttggaatgggctctagcacacag

SEQ ID NO: 2222 - DNA, 628 bp, Artificial Sequence
  Synthetic polypeptide
atggccctgaccctgtttgatacagatgaatatagacctcctgtttggaaatcttacttatatcagctacaacaggaagcccctcatcctcgaagaattacctgtacttgcgaggcaaggatcatcagtcattggatgttaaaaccattggaagaaaggctgtaggtgaacaggatatttacatggtctcaaggtatgacaccaccaattatttgttaattgcatagagaaaaatatgcctttaaagtggagagatctggtggtcaaacttagcattacctgtaatgggacaaactgtcatgtgtctcctgaagtgatacagtgaaacacacggtatcacctgtataatatttttgccaaaactgtttaacttaaatctagttataaagtacgaatcagacaaattcagaatgtgtaccttccataagacatctgccctgggtttataaataatgtcattatcataaaaaaaaaacagtggtgggatgatataaaattaaaggagactaaagagacatggccatcagattcaaggaccttgatcgggtcctcaacttatatatatattgtaaagctataaattttgagtacaattggataaatttgagtatggactgtattaggtaat

SEQ ID NO: 2223 - DNA, 190 bp, Artificial Sequence; identical to SEQ ID NO: 1996
  Synthetic polypeptide

SEQ ID NO: 2224 - DNA, 1728 bp, Artificial Sequence
  Synthetic polypeptide
atgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagcactgttcacaggagcaaagtcttggaaccaacccaaatgcccatcaacgatagactggatacagaaatgtggtacgtatataccatggaatactatgcaaccatagaaaaggatgagttcctgtcctttgcagggacatggatgaaactggaaaccatcatcctcagcaaactaacacaggaacagaaaaccaaacactgtatgttctcactcataagtgggagttgaacaatgagaaaacatggacacagggagggggacatcacacactggggcctgtcgggaggtgggggctaggggagggatagcattaggagaaatacctaatgtagatgacgagttgatgagtgcagcaacccaccatggtacgtgtgtacctatgtaacaaacctgcatgttctgcacatgcatcccagaacttaaagtataacaacaaaaaaa

SEQ ID NO: 2225 - DNA, 1680 bp, Artificial Sequence
  Synthetic polypeptide
atgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagcactgttcacaggagcaaagtcttggaaccaacccaaatgcccatcaacgatagactggatacagaaatgtggtacgtatataccatggaatactatgcaaccatagaaaaggatgagttcctgtcctttgcagggacatggatgaaactggaaaccatcatcctcagcaaactaacacaggaacagaaaaccaaacactgtatgttctcactcataagtgggagttgaacaatgagaaaacatggacacagggagggggacatcacacactggggcctgtcgggaggtgggggctaggggagggatagcattaggagaaatacctaatgtagatgacgagttgatgagtgcagcaacccaccatggtacgtgtgtacctatgtaacaaacctgcatgttctgcacatgcatcccagaacttaaagtataacaacaaaaaaa

SEQ ID NO: 2226 - DNA, 1512 bp, Artificial Sequence
  Synthetic polypeptide
atggtgtttgaaaaggtgttcccggacgcagtagatcctggagatgtggttacacagcttgaattgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagcactgttcacaggagcaaagtcttggaaccaacccaaatgcccatcaacgatagactggatacagaaatgtggtacgtatataccatggaatactatgcaaccatagaaaaggatgagttcctgtcctttgcagggacatggatgaaactggaaaccatcatcctcagcaaactaacacaggaacagaaaaccaaacactgtatgttctcactcataagtgggagttgaacaatgagaaaacatggacacagggagggggacatcacacactggggcctgtcgggaggtgggggctaggggagggatagcattaggagaaatacctaatgtagatgacgagttgatgagtgcagcaacccaccatggtacgtgtgtacctatgtaacaaacctgcatgttctgcacatgcatcccagaacttaaagtataacaacaaaaaaa

SEQ ID NO: 2227 - DNA, 154 bp, Artificial Sequence
  Synthetic polypeptide
atggcttccaattttaatgacatagtgaagcaagggtacgtgaggatccggagcagacgcctcggggtgctgatcctgagagccctccgcagtgaacaccctgcatgcagatctccttcttggaacctgttcctggaaaacccagtctccagca

SEQ ID NO: 2228 - DNA, 480 bp, Artificial Sequence
  Synthetic polypeptide
atggcggtgtctacagtgttctcgacttcgtcgctggtgactgggtacctggatatgtgatcgagtattcttctgggtgtttctatgaggatgtttttggatgaaattggcatttaaattggtaaactgagtaaagcagtctgtccccctaaccggggtgggcttcatgtaatcagctcaaggtttgaatacaacaaaaagacttacactctcgcaagtgaaaggcaattctttctgcctggtagccttcaaactgagacacaggcttttatcctgccttcagattcgcctgggaacactggctcttcctgagtctcaagcctgctggccttgagacaagaactacatcagctctctcagttctcaagcctttggacttactctggaactaagccatcagctctcttgggtcgtcagcttgccaaccaactcatcctgaagatcttgggacttgccagccttcatagtcacgtgggccaa

SEQ ID NO: 2229 - DNA, 117 bp, Artificial Sequence; identical to SEQ ID NO: 928
  Synthetic polypeptide

SEQ ID NO: 2230 - DNA, 51 bp, Artificial Sequence; identical to SEQ ID NO: 929
  Synthetic polypeptide

SEQ ID NO: 2231 - DNA, 162 bp, Artificial Sequence
  Synthetic polypeptide
atgttgcgcaagtttacacttctgaccccatcacactgcttcccactgagatgcaagagaggattcctcatcttccagatgtgcaggctgaaatatttatggatgaaattgtcagatgcctagcatttgctccatgataatctgaggtaaggaagacagtgg

SEQ ID NO: 2232 - DNA, 1030 bp, Artificial Sequence
  Synthetic polypeptide
atggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagcttggaggagtagaaagagcatggtcttgaagtcaagcagac

SEQ ID NO: 2233 - DNA, 1204 bp, Artificial Sequence
  Synthetic polypeptide
atgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagcttggaggagtagaaagagcatggtcttgaagtcaagcagac

SEQ ID NO: 2234 - DNA, 238 bp, Artificial Sequence
  Synthetic polypeptide
atggcggcgcctttgaggattcagagcgactgggcgcaagccctcaggaaggatgaaggggaggcctggctgagctgtcatcccccagtggaagcagcctgaggctctcatcagaagcagatgctggtgccatgcttcttgtacagtctgcagaaccgtgagccaaataaacctcttttctttataaattacccagcctcaggtattcctttatagcaacactaaacagactaagaca

SEQ ID NO: 2235 - DNA, 377 bp, Artificial Sequence
  Synthetic polypeptide
atgggcggggcgcggctcggagcgcgaaacatggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagggctgctggcagggtgatagcagatgatggcacgaaggtcctttaggacatggcc

SEQ ID NO: 2236 - DNA, 347 bp, Artificial Sequence
  Synthetic polypeptide
atggcggggcaggacgctggctgcggccgtggcggcgacgactactcagaggacgagggcgacagcagcgtgtccagggcggctgtggaggtgttcgggaagctgaaggacctaaactgccccttcctcgagggtctgtatatcacagagccaaagacaattcaggaactgctgtgcagcccctcagagtaccgcttggagatcctagagtggatgtgtacccgggtctggccctcactgcaggacaggttcagctcactgaaaggggtcccaacagaggtgaagatccaagggctgctggcagggtgatagcagatgatggcacgaaggtcctttaggacatggcc

SEQ ID NO: 2237 - DNA, 1290 bp, Artificial Sequence
  Synthetic polypeptide
atgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggtgcagtggctcacgcctgtaatcccagcactttgggaggctgaagctggcggatcacctgaggtcagtagttcgagaccagcctggccaacatggtgaaaccctgtctctactaaaaatacaaaaaattagccaggcgtggtggtgggcacctgtaatcccagctactcgggaggctgaggcaggagaaatgcttgaatccagaaggcggaggttgcagtgagccaagattgtgccattggcctccagcctgggcaacaagagctgaactctatctcaaaaaataaataaataaaa

SEQ ID NO: 2238 - DNA, 4039 bp, Artificial Sequence
  Synthetic polypeptide
atgactgaggctctccaatgggccagatatcactggcgacggctgatcagaggtgcaaccagggatgatgattcagggccatacaactattcctcgttgctcgcctgtgggcgcaagtcctctcagacccctaaactgtcaggaaggcaccggattgttgttccccacatccagcccttcaaggatgagtatgagaagttctccggagcctatgtgaacaatcgaatacgaacaacaaagtacacacttctgaattttgtgccaagaaatttatttgaacaatttcacagagctgccaatttatatttcctgttcctagttgtcctgaactgggtacctttggtagaagccttccaaaaggaaatcaccatgttgcctctggtggtggtccttacaattatcgcaattaaagatggcctggaagattatcggaaatacaaaattgacaaacagatcaataatttaataactaaagtttatagtaggaaagagaaaaaatacattgaccgatgctggaaagacgttactgttggggactttattcgcctctcctgcaacgaggtcatccctgcagacatggtactactcttttccactgatccagatggaatctgtcacattgagacttctggtcttgatggagagagcaatttaaaacagaggcaggtggttcggggatatgcagaacaggactctgaagttgatcctgagaagttttccagtaggatagaatgtgaaagcccaaacaatgacctcagcagattccgaggcttcctagaacattccaacaaagaacgcgtgggtctcagtaaagaaaatttgttgcttagaggatgcaccattagaaacacagaggctgttgtgggcattgtggtttatgcaggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtcatggaatctggctgagcaggtatgaaaagatgcattttttcaatgttcccgagcctgatggacatatcatatcaccactgttggcaggattttatatgttttggaccatgatcattttgttacaggtcttgattcctatttctctctatgtttccatcgaaattgtgaagcttggacaaatatatttcattcaaagtgatgtggatttctacaatgaaaaaatggattctattgttcagtgccgagccctgaacatcgccgaggatctgggacagattcagtacctcttttccgataagacaggaaccctcactgagaataagatggtttttcgaagatgtagtgtggcaggatttgattactgccatgaagaaaatgccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaagatcagacacccttcactgggggggttgcccattaagtctttggaagagattaaaagtcttttccagagatggtctgtccgaagatcaagttctccatcgcttaacagtgggaaagagccatcttctggagttccaaacgcctttgtgagcagactccctctctttagtcgaatgaaaccagcttcacctgtggaggaagaggtctcccaggtgtgtgagagcccccagtgctccagtagctcagcttgctgcacagaaacagagaaacaacacggtgatgcaggcctcctgaatggcaaggcagagtccctccctggacagccattggcctgcaacctgtgttatgaggccgagagcccagacgaagcggccttagtgtatgccgccagggcttaccaatgcactttacggtctcggacaccagagcaggtcatggtggactttgctgctttgggaccattaacatttcaactcctacacatcctgccctttgactcagtaagaaaaagaatgtctgttgtggtccgacaccctctttccaatcaagttgtggtgtatacgaaaggcgctgattctgtgatcatggagttactgtcggtggcttccccagatggagcaagtctggagaaacaacagatgatagtaagggagaaaacccagaagcacttggatgactatgccaaacaaggccttcgtactttatgtatagcaaagaaggtcatgagtgacactgaatatgcagagtggctgaggaatcattttttagctgaaaccagcattgacaacagggaagaattactacttgaatctgccatgaggttggagaacaaacttacattacttggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagatgcctgtgggatgctgatgagcacaattttgaaagaacttcagaagaaaactcaagccctgccagagcaagtgtcattaagtgaagatttacttcagcctcctgtcccccgggactcagggttacgagctggactcattatcactgggaagaccctggagtttgccctgcaagaaagtctgcaaaagcagttcctggaactgacatcttggtgtcaagctgtggtctgctgccgagccacaccgctgcagaaaagtgaagtggtgaaattggtccgcagccatctccaggtgatgacccttgctattggtgatggtgccaatgatgttagcatgatacaagtggcagacattgggataggggtctcaggtcaagaaggcatgcaggctgtgatggccagtgactttgccgtttctcagttcaaacatctcagcaagctccttcttgtccatggacactggtgttatacacggctttccaacatgattctctattttttctataagaatgtggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaaccccctgaacacagccgctctgttcatcgttctcctccatctggtcattgaaagcaagagtttgaccaggtgcagtgactcacacctgcaattccagagctttgggaggctgtggatcacatgaagctaagagttcaagaccagcctgggcaacatagtgagaccctgtctctaaaaaaaataacaaaactaactgtgtgtcatggcacctgccagcagtcttggccacttgggagactgaggaggaggctcacttgagcccaacagttggaggctgcagtaagctatgatcatgccactgcactccagcttgggaaacagagagaaaccttgtctctaaaaacaaaaaa

SEQ ID NO: 2239 - DNA, 578 bp, Artificial Sequence
  Synthetic polypeptide
atgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagccatgattgtaagtttcctgagacctctccagccatgcagaactgtgagtcaattaaacctcttttgtttatgtattacccagtctcaggtaatgtctttatagcagtgtgaaaatgaactaataca

SEQ ID NO: 2240 - DNA, 276 bp, Artificial Sequence; identical to SEQ ID NO: 923
  Synthetic polypeptide

SEQ ID NO: 2241 - DNA, 2721 bp, Artificial Sequence; identical to SEQ ID NO: 962
  Synthetic polypeptide

SEQ ID NO: 2242 - DNA, 2549 bp, Artificial Sequence; identical to SEQ ID NO: 963
  Synthetic polypeptide

SEQ ID NO: 2243 - DNA, 669 bp, Artificial Sequence; identical to SEQ ID NO: 1845
  Synthetic polypeptide

SEQ ID NO: 2244 - DNA, 993 bp, Artificial Sequence
  Synthetic polypeptide
atgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacaggaattccagaatagctaaataattacttgtccatggtactttggagagaattcaagcatt

SEQ ID NO: 2245 - DNA, 645 bp, Artificial Sequence; identical to SEQ ID NO: 137
  Synthetic polypeptide

SEQ ID NO: 2246 - DNA, 483 bp, Artificial Sequence
  Synthetic polypeptide
atggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccggaggaccaactgaataaaccacagcacatccacgtagcagatgcctctaccaagtggagtgaggaagagctctataccgctacagaattgtctctgggatatagttacatgaacaaaagcaacttgcagaccgtgtttataggatagcacc

SEQ ID NO: 2247 - DNA, 3516 bp, Artificial Sequence
  Synthetic polypeptide
atgccagaacccactaagaaagaggactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2248 - DNA, 3648 bp, Artificial Sequence
  Synthetic polypeptide
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2249 - DNA, 3555 bp, Artificial Sequence
  Synthetic polypeptide
atgccagaacccactaagaaagaggatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2250 - DNA, 3552 bp, Artificial Sequence
  Synthetic polypeptide
atgccagaacccactaagaaagaggaaaatgaagtgccagccccagccccacccccggaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2251 - DNA, 3669 bp, Artificial Sequence
  Synthetic polypeptide
atgccagaacccactaagaaagaggaaaatgaagtgccagccccagccccacccccggaagaaccaagtaaagagaaggaggccggaactacaccagcaaaagatgaagaggaagtctccccgcctagcgccttgcctccaggtttgggtagtcgggccctggagagaaaagattcagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2252 - DNA, 3687 bp, Artificial Sequence
  Synthetic polypeptide
atgccagaacccactaagaaagaggaaaatgaagtgccagccccagccccacccccggaagaaccaagtaaagagaaggaggccggaactacaccagcaaaagatgaagaggaagtctccccgcctagcgccttgcctccagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaagtacatcagcaaaacagtctgatgaaaatggggaggctgcctatgatctgccagctgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2253 - DNA, 3594 bp, Artificial Sequence
  Synthetic polypeptide
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2254 - DNA, 3537 bp, Artificial Sequence
  Synthetic polypeptide
atgccagaacccactaagaaagaggaaaatgaagtgccagccccagccccacccccggaagaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2255 - DNA, 3558 bp, Artificial Sequence
  Synthetic polypeptide
atgccagaacccactaagaaagaggaaccaagtaaagagaaggaggccggaactacaccagcaaaagactggacccttgtcgaaactcctcctggggaggaacaagccaagcagaatgccaactcccagctgtccatcttgttcattgaaaaacctcaaggaggaacagtgaaagttggtgaagatatcaccttcatagccaaagtcaaggctgaagatcttctgagaaaacccactatcaaatggttcaaaggaaaatggatggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2256 - DNA, 3297 bp, Artificial Sequence
  Synthetic polypeptide
atggacctggccagcaaagccgggaagcaccttcagctgaaggaaacctttgagaggcacagtcgggtgtacacatttgagatgcagatcatcaaggccaaagataactttgcaggaaattacagatgcgaggtcacctataaggataagtttgacagctgttcatttgatcttgaagtgcacgaatctactgggactactccaaacattgacatcagatctgctttcaagagaagtggagaaggtcaagaggatgcaggagaacttgactttagtggtctcctgaaacgtagggaggtgaagcagcaggaggaagaaccccaggtggacgtatgggagttgctgaagaacgcgaaacccagtgagtacgagaagatcgccttccagtatggaatcaccgacctgcgcggcatgctcaagcgactcaagcgcatgcgcagagaggagaagaagagcgcagcttttgcaaaaattcttgatcctgcatatcaggttgacaaaggaggcagagtgaggtttgttgtggagctggcagatccaaagttggaggtgaaatggtataaaaatggtcaagaaattcgacccagtaccaaatacatctttgaacacaaaggatgccagagaatcctgtttatcaataactgtcagatgacagatgattcagagtattatgtgacagccggtgatgagaaatgttccactgagctcttcgtaagagagcctccaattatggtgaccaaacagctggaagatacaactgcttattgtggggagagagtggaattagaatgtgaggtgtctgaagatgatgccaatgtaaaatggtttaagaatggtgaagagattatccctggtccaaaatcaagataccgaattagagttgagggtaaaaaacacatcttgatcatagagggagcaacaaaggctgatgctgcagaatattcagtaatgacaacaggaggacaatcatctgctaaacttagtgttgacttgaaacctctgaagattttgacacctctgactgatcagactgtaaatcttggaaaagaaatctgcctgaagtgtgaaatctctgaaaacataccaggaaaatggactaaaaatggcctacctgttcaggagagtgaccgtctaaaggtggttcacaagggaaggatccacaagttagtgatagccaatgccctcactgaagatgaaggtgattatgtatttgcacctgatgcctacaatgttactctgcctgccaaagttcatgttattgatcctcctaagatcatcctggatggtcttgatgctgacaacacagtgacagtgattgcaggaaacaagcttcgtcttgagatccccatcagcggagaaccacctcctaaagccatgtggagccggggagataaggctattatggaaggcagtggccggataagaacagaatcttaccctgatagcagcactctggtcattgatatagctgaaagagatgactctggtgtttaccacatcaatctgaaaaacgaagctggagaggcacatgcaagcatcaaggttaaagttgtggacttccctgatcctccagtggcaccgactgtgacagaggtgggagatgactggtgtatcatgaactgggagcctcctgcctacgacggaggctctccaatcctaggatattttattgagaggaagaagaaacaaagctccaggtggatgaggctgaattttgatctctgcaaagaaacaacttttgagcccaagaagatgattgaaggtgtggcctatgaggtccgcatctttgcagtcaatgccattggcatctccaagcccagtatgccctccaggccttttgttcctttggctgtaacaagccctcctactcttctgactgtggactctgtcactgacacgactgtcacgatgaggtggcgccccccagaccacattggtgcagcaggtttagatggctatgtgctagagtattgctttgaaggaactgaggactggatagttgcaaacaaagatctgattgacaagacgaagttcaccatcacaggtctgccaacagatgcaaagatctttgtgcgtgtgaaggctgttaatgcagctggtgccagcgagcccaagtactattctcagcccattctcgtgaaggaaatcatagaacctccaaagattcgcattccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccaggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaagatgactggagcttcaccagccattctgaatcatgagatggccttatagatacaagtcagagaggatattggagcagagagacagaaaagcctgagttcctgatgaccatggaaacatcgtaccagtcttggagtgccaattctgtacttcttttatgtgagagagaaataaattcctgttgtctaagctattcagtctgtggtattttgttatgacaatccaagctgactaataca

SEQ ID NO: 2257 - DNA, 1071 bp, Artificial Sequence
  Synthetic polypeptide
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagaaaatgtttctgacc

SEQ ID NO: 2258 - DNA, 1122 bp, Artificial Sequence
  Synthetic polypeptide
atggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagtaaagcggggtggccactactccagtgcctattctacagccaaatccccagttaatggaactcccagcagccaactttctactcctaaatctacgaaatcctccagttcctctccaactagtccaggaagtttcagaggattaaagaaaatgtttctgacc

SEQ ID NO: 2259 - DNA, 180 bp, Artificial Sequence
  Synthetic polypeptide
atgttcggtgcatgttataaacaaccacttaaaccctccggatctgagcctcccgcagaggaatgcagaatgacgccacggcacgcaggatgtgatgtcaccgagatgcagaggatactcagtcaaccaacatttactgagcatctacttcgtgccgtatattgactcttttcgccgaca

SEQ ID NO: 2260 - DNA, 5958 bp, Artificial Sequence
  Synthetic polypeptide
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaccaagctttttcccatcttcccacaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2261 - DNA, 5904 bp, Artificial Sequence
  Synthetic polypeptide
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2262 - DNA, 4677 bp, Artificial Sequence
  Synthetic polypeptide
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2263 - DNA, 6018 bp, Artificial Sequence
  Synthetic polypeptide
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2264 - DNA, 6021 bp, Artificial Sequence
  Synthetic polypeptide
atggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgacgttcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagagcttcgagaagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcgcccgcgcccggccggcagcacggccagatccgcggctaccaggtccactacgtgcgcatggagggcgccgaggcccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgctgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccgcggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaagaagccccatagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggattgaggccatcaagctacagatgatcttacaaatggaaccccaaatgagctcaactaacaacttctactgaggacccctggaccaacctgctggccctttcactggcctaaagagttcccctctggaggacaccacaactgcagggccccttcttcgcccctatccagcaggaagtagctagagcggtcatcgcccaattcccaacagcagttggggtgtcctgtttagatgggggat

SEQ ID NO: 2265 - DNA, 316 bp, Artificial Sequence
  Synthetic polypeptide
atgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagtgagctccagtgctgtgaatctctgcttaaagcaccatatgacatt

SEQ ID NO: 2266 - DNA, 441 bp, Artificial Sequence
  Synthetic polypeptide
atgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggtttcctgaggcctccccagccacgcttcctgtacagcctgcagaactgtgagtcaattaaacctcttttcttcataaattacccagtttctcatagttctttatagcagtgtgaaaacagactaat

SEQ ID NO: 2267 - DNA, 978 bp, Artificial Sequence
  Synthetic polypeptide
atgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggaattccagaatagctaaataattacttgtccatggtactttggagagaattcaagcatt

SEQ ID NO: 2268 - DNA, 353 bp, Artificial Sequence
  Synthetic polypeptide
atggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaaggccccaggagatgaggaagcccaggtggagaacctcatcaccgccaatgcaacagagccccagaaagcagagaactgaagtgcagccatcaggtggaagggtcaaagtgatacaatggacatcgaagcaccgtgacaattctccatgtagccattatgctataaatgttggcatcactat

SEQ ID NO: 2269 - DNA, 340 bp, Artificial Sequence
  Synthetic polypeptide
atggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgcaacagagccccagaaagcagagaactgaagtgcagccatcaggtggaagggtcaaagtgatacaatggacatcgaagcaccgtgacaattctccatgtagccattatgctataaatgttggcatcactat

SEQ ID NO: 2270 - DNA, 362 bp, Artificial Sequence
  Synthetic polypeptide
atggagttggtgctggtcttcctctgcagcctgctggcccccatggtcctggccagtgctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccagcaacagagccccagaaagcagagaactgaagtgcagccatcaggtggaagggtcaaagtgatacaatggacatcgaagcaccgtgacaattctccatgtagccattatgctataaatgttggcatcactat

SEQ ID NO: 2271 - DNA, 342 bp, Artificial Sequence
  Synthetic polypeptide
atggcgctcgaccccgcagaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactcctcctttggcctgcgccttccatcatttttgcctggattattttaacagtttattggctatcttgcctctaaccttgcttgcctccttttgtcctatctgccacatgttgtcagattcatccaagacacaaaactgatc

SEQ ID NO: 2272 - DNA, 252 bp, Artificial Sequence
  Synthetic polypeptide
atggcgctcgaccccgcagattttaccaaatgttgcaagaactctggagttcttatggtagtaaaatgccggaaagaaaattctgcattgaaagaatgtctaactgcttactcctcctttggcctgcgccttccatcatttttgcctggattattttaacagtttattggctatcttgcctctaaccttgcttgcctccttttgtcctatctgccacatgttgtcagattcatccaagacacaaaactgatc

SEQ ID NO: 2273 - DNA, 361 bp, Artificial Sequence
  Synthetic polypeptide
cagagtaaacagtagcaccaaactgtcttcaggagcaaaccagcatctcagacatgtcgaaaaagatgttttgatccctaaaataatgagagaaaaggccaaagagaggtgttctgaacaagttcaagattttaccaaatgttgcaagaactctggagttcttatggtagtaaaatgccggaaagaaaattctgcattgaaagaatgtctaactgcttactcctcctttggcctgcgccttccatcatttttgcctggattattttaacagtttattggctatcttgcctctaaccttgcttgcctccttttgtcctatctgccacatgttgtcagattcatccaagacacaaaactgatc

SEQ ID NO: 2274 - DNA, 1055 bp, Artificial Sequence
  Synthetic polypeptide
atgtcgtttgctgagagcgggtggcggtcggctctgcggcgccgcggtcccggcaccccgggccctgtggctcggccatcgtattcctcctttactcagggggacagctggggtgaaggcgaagtcgacgaggaggagggatgcgaccaagtggcccgcgacctgcgggcggagttctcggctggggcgtggtcagagcccagaaagcgctcggtgctcccgccggacgggaacgggtcgcccgttctgcccgataagcgcaatggtatctttcccgcggccgcgggcagcagagcccagcctcggcggtggccggtccaggtcctctctattctctgctcgctgctcttcgccattcttctcgccttcctcctcgccatcgcctacttgatcgttaaagagttgcatgctgagaatttgaaaaatgaagatgatgtagacactggactattaggattctggactctacttataatatccctaactgctggattctcctgttgcagcttttcttggacagtgacttactttgattcttttgaaccaggaatgtttcctcctactcctctttcacctgccaggttcaagatctatccaagagaaataagtgcagattcccaccacccaccgaagacgtgttcatagtacctgtatgtataggagccccaaactggaaacacccatcagtagtaaaatgggtaaatacattttgctatatactgcagtagaaaagaacaaactaatactacatacaacatggatgaatctcacaaagacagtactgagcaaaagaaggcagacgcagaaaaatatttattgtatgatgccatgtagatgtagtttcaagagcaagtgaaactaatcttggtgacagccctcagtattgcagttacctcaagatctgcaggaggtaagttgaatatttaaaagggatctttttgcagtgccagaaatgttctctatctttatgtggttggtgagtatatgagagtctaccacagtaaaaatgcattgaactgtatataaatgttagacatttgcattttactggtatg

SEQ ID NO: 2275 - DNA, 1481 bp, Artificial Sequence
  Synthetic polypeptide
atggatcccaaactcgggagaatggctgcgtccctgctggctgtgctgctgctgctgctggagcgcggcatgttctcctcaccctccccgcccccggcgctgttagagaaagtcttccagtacattgacctccatcaggatgaatttgtgcagacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccatcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtgatgagaagctaagctgaggag

SEQ ID NO: 2276 - DNA, 1352 bp, Artificial Sequence
  Synthetic polypeptide
atggatcccaaactcgggagaatgacgctgaaggagtgggtggccatcgagagcgactctgtccagcctgtgcctcgcttcagacaagagctcttcagaatgatggccgtggctgcggacacgctgcagcgcctgggggcccgtgtggcctcggtggacatgggtcctcagcagctgcccgatggtcagagtcttccaatacctcccatcatcctggccgaactggggagcgatcccacgaaaggcaccgtgtgcttctacggccacttggacgtgcagcctgctgaccggggcgatgggtggctcacggacccctatgtgctgacggaggtagacgggaaactttatggacgaggagcgaccgacaacaaaggccctgtcttggcttggatcaatgctgtgagcgccttcagagccctggagcaagatcttcctgtgaatatcaaattcatcattgaggggatggaagaggctggctctgttgccctggaggaacttgtggaaaaagaaaaggaccgattcttctctggtgtggactacattgtaatttcagataacctgtggatcagccaaaggaagccagcaatcacttacggaacccgggggaacagctacttcatggtggaggtgaaatgcagagaccaggattttcactcaggaacctttggtggcatccttcatgaaccaatggctgatctggttgctcttctcggtagcctggtagactcgtctggtcatatcctggtccctggaatctatgatgaagtggttcctcttacagaagaggaaataaatacatacaaagccatccatctagacctagaagaataccggaatagcagccgggttgagaaatttctgttcgatactaaggaggagattctaatgcacctctggaggtacccatctctttctattcatgggatcgagggcgcgtttgatgagcctggaactaaaacagtcatacctggccgagttataggaaaattttcaatccgtctagtccctcacatgaatgtgtctgcggtggaaaaacaggtgacacgacatcttgaagatgtgttctccaaaagaaatagttccaacaagatggttgtttccatgactctaggactacacccgtggattgcaaatattgatgacacccagtatctcgcagcaaaaagagcgatcagaacagtgtttggaacagaaccagatatgatccgggatggatccaccattccaattgccaaaatgttccaggagatcgtccacaagagcgtggtgctaattccgctgggagctgttgatgatggagaacattcgcagaatgagaaaatcaacaggtgatgagaagctaagctgaggag

SEQ ID NO: 2277 - DNA, 2267 bp, Artificial Sequence
  Synthetic polypeptide
atggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2278 - DNA, 2264 bp, Artificial Sequence
  Synthetic polypeptide
atggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2279 - DNA, 731 bp, Artificial Sequence
  Synthetic polypeptide
atgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2280 - DNA, 1565 bp, Artificial Sequence
  Synthetic polypeptide
atggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggcataggggttcacacctgaaatcccagcactttgaaaggctgagctaggaggattggttgaatccagaagtttgagaccagcttggacgacatagtgagaacccatctctacaaaaaattttaaatttagctgggtgtggtggcaccgtcctatagtcccacctattctggaggctgaggtgggaggaccacttgagcctgggagattgaggctacagtgagccatgatcatgccaccgcactccagcctgggcaacagaacaagattgtgtgtcaagaaataaataaaaataaaaa

SEQ ID NO: 2281 - DNA, 916 bp, Artificial Sequence; identical to SEQ ID NO: 1226
  Synthetic polypeptide

SEQ ID NO: 2282 - DNA, 1898 bp, Artificial Sequence
  Synthetic polypeptide
atggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggacttcctgtatgtcacacccacgcctctgcaggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacgggatgtggcaaactcagttgaggccagatgtg

SEQ ID NO: 2283 - DNA, 1865 bp, Artificial Sequence
  Synthetic polypeptide
atggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctggaatgactttctcaccggtgtgtttcctgccagccccctcagttggcttttcctcttcagtgccatccagcttgcctggttcctccagctggatccttccttaggactgatggagaagatcaaagagttgctgcctgactggggtggacaacaccacgggctccggggggtcctggcagccgcgctgtttgcctcgtgtttgtggggagccctgatcttcacactgcacgtggccctgaggctgcttctgtcctaccacggctggcttcttgagccccacggagccatgtcctcccccaccaagacctggctggccctggtccgcatcttctctggccgccacccgatgctgttcagttaccagcgctccctgccacgccagcccgtgccctctgtgcaggacaccgtgcgcaagtacctggagtcggtccggcccatcctctccgacgaggacttcgactggaccgcggtcctggcgcaggaattcctgaggctgcaggcgtcgctgctgcagtggtacctgcggctcaagtcctggtgggcgtccaattatgtcagtgactggtgggaggaatttgtgtacctgcgctcccgaaatccgctgatggtgaacagcaactattacatgatggcagctcgcgctgggaatgccgtccatgccctcctcctgtaccgccaccgcctgaaccgccaggagatacccccgactttgctgatgggaatgcgccccttatgctctgcccagtacgagaagatcttcaacaccacgcggattccaggggtccaaaaagactacatccgccacctccatgacagccaacacgtggctgtcttccaccggggccgattcttccgcatggggacccactcccgaaacagcctgctttccccgagagccctggagcagcagtttcagagaatcctggatgatccctcaccggcctgcccccacgaggaacatctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacgggatgtggcaaactcagttgaggccagatgtg

SEQ ID NO: 2284 - DNA, 764 bp, Artificial Sequence
  Synthetic polypeptide
ctggcagctctgacagctgctcccaggggcacgtgggcccaggtgcggacatccctgaagacccaggcagcggaggccctggaggcggtggaaggggccgctttctttgtgtcactggatgctgagcccgcggggctcaccagggaggacccggcagcgtcgttggatgcctacgcccatgctctgctggccggccggggccatgatcgctggtttgacaaatccttcaccctaatcgtcttctctaacgggaagctgggcctcagcgtggagcactcctgggccgactgccccatctcaggacacatgtgggagttcactctggctacagaatgctttcagctgggctactcaacagacggccactgcaaggggcacccggaccccacactaccccagccccagcggctgcaatgggaccttccagaccagatccactcctccatctctctagccctgaggggagccaagatcttgtctgaaaatgtcgactgccatgtcgttccattctccctatttggcaagagcttcatccgacgctgccacctctcttcagacagcttcatccagatcgccttgcaactggcccacttccgggacaggggtcaattctgcctgacttatgagtcggccatgactcgcttattcctggaaggccggacggagacggtgcggtcttgcacgagggaggcctgcaactttgtcagggccatggaggacaaagagaagacgggatgtggcaaactcagttgaggccagatgtg

SEQ ID NO: 2285 - DNA, 860 bp, Artificial Sequence
  Synthetic polypeptide
ctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 2286 - DNA, 1823 bp, Artificial Sequence
  Synthetic polypeptide
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcccgcgcaaggcctggcacctggtcggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 2287 - DNA, 1796 bp, Artificial Sequence
  Synthetic polypeptide
atgggcccgggacccccagcggccggagcggcgccgtccccgcggccgctgtccctggtggcgcggctgagctacgccgtgggccacttcctcaacgacctgtgcgcgtccatgtggttcacctacctgctgctctacctgcactcggtgcgcgcctacagctcccgcggcgcggggctgctgctgctgctgggccaggtggccgacgggctgtgcacaccgctcgtgggctacgaggccgaccgcgccgccagctgctgcgcccgctacggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcccgaggcggagaacaccgaacacccagtgaaggtgaggggatcagcacggcgccgccaccgtgctggaacgagactcagccacaaggaggtgcgaagctctgacccaggccacagtgcggatgcaccttgaggatgtcacgctcagtgagagacaccagacacagaagggtacgctgtgatcccacttctatgaaatgtccaggacagaccaatccacagaatcagggagaggattcgtgggtgccgggactggggagggggacctgggggtgactaggtgacataatggggacagggctgccttctgggtgatgagaatgttctggaatcagatgggatggctgcacggcgtggtgaaggtactgaacgccacctcactgtaagacggtagattttgtatt

SEQ ID NO: 2288 - DNA, 230 bp, Artificial Sequence
  Synthetic polypeptide
atgcttctctcgttacctgccttacatcttcagacctccgaacaccatcctttcttccagctgccacacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2289 - DNA, 235 bp, Artificial Sequence
  Synthetic polypeptide
atgaaatgcttctctcgttacctgccttacatcttcagacctccgaacaccatcctttcttccagctgccacacagaagatgtgccttgcttccccttcgccttctgccatgattgtaagtttcctgagacctccccagccatgcagaactgtgagtcaattaaacttttctttataatttacccagtctcaggcagttatttatacaatagctgtgtgagaacgaactaatgca

SEQ ID NO: 2290 - DNA, 97 bp, Artificial Sequence
  Synthetic polypeptide
atgtctgcagatgtctccaaggagtccgaggacaagtccgaagtcagcgacaagcaatgatggcgatgacgatcctagtcaataaaaacgggggaga

SEQ ID NO: 2291 - DNA, 2158 bp, Artificial Sequence
  Synthetic polypeptide
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcagatagaaaaggagggagttacactcaggctgcaagcagtgacagtgcccagggctctgatgtgtccctcacagcttgtaaagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagc

SEQ ID NO: 2292 - DNA, 2176 bp, Artificial Sequence
  Synthetic polypeptide
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggagctgtcttcccagcccaccatccccatcgtgggcatcattgctggcctggttctccttggagctgtgatcactggagctgtggtcgctgccgtgatgtggaggaggaagagctcaggtggagaaggggtgaaggatagaaaaggagggagttacactcaggctgcaagcagtgacagtgcccagggctctgatgtgtccctcacagcttgtaaagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacgaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctccccgccgccacacacacacacaaagtaaaagacacacttgcatcttgcatcctcaccagaaggaaggatgcacactaccttgtgagcctctctgggttctagcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagc

SEQ ID NO: 2293 - DNA, 504 bp, Artificial Sequence
  Synthetic polypeptide
atgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagcctggtggcgcatgcctgtaatcccagctgctagggaagctgaggcaggagaatcacttgaactcgcgaggcagagattgcggtgagccgagacagcaccattgcactccagcctgggtgacaagagcgaaactccgtctcaaaaaacaaaaaacacacaaacaa

SEQ ID NO: 2294 - DNA, 378 bp, Artificial Sequence
  Synthetic polypeptide
atggtggaagccggtaaggcctacgtcagcaccagcaggcttttcgtgagcggcgtccgcgacctgtcccagcagtgccagggcgacaccgtcatctcggaatgtctgcagaggttcgctgacagcctacaggaggtggtgaactaccacatgatcctgtttgaccaggcccagaggtccgtgcggcagcagctccagagctttgtcaaagagcctggtggcgcatgcctgtaatcccagctgctagggaagctgaggcaggagaatcacttgaactcgcgaggcagagattgcggtgagccgagacagcaccattgcactccagcctgggtgacaagagcgaaactccgtctcaaaaaacaaaaaacacacaaacaa

SEQ ID NO: 2295 - DNA, 564 bp, Artificial Sequence
  Synthetic polypeptide
atgagctgccgcggacggggcgcgggcggacgatggaactccacatcctggagcaccggctgcaagttgccagcgtcgccaaggagagtatcccgctgttcacctacgggcctgatcaaacttgccttcctgttctccaagaccaggtgcaagttcttcagtctgactgagacaccagaggattacactatcattgtcgatgaggaaggattcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgaggatacaactagaagccagcagtctacaggctggaagaaggccctcaccagaacccaacccttggacttcagcctccagaactgtgagaaatacatacctgctgtttgtaagacaccagtctatggaattctgttacagtagcctgaac

SEQ ID NO: 2296 - DNA, 575 bp, Artificial Sequence
  Synthetic polypeptide
atgcaccaacgaggaggtgaggagcgcctctttccggccgccatcacatctaggaaggaggagcgtctctgcccggccgcccatcgtctgagatgtggggagcgcctctgccccgccgccccgtctgggatgtgaggagcacctctgcccggccacgaccccgtctgggaggtgaggagcatctctgccccgccgccccgtctgagaagtgaggagaccctctgcccggcaaccaccccgtctgagaagtgaggagaccctccacccggcagctgccccgtctgagaaatgaggagcctctccgcccggcagccaccccgtctgggaagtgaggagcgtctccgcccggcagccaccccgtccgggagggaggtggggggggtcagcccccccgccaggccagcagccccatccgggagggaggtgggggggtcagccccacgccccgccagccgccccgtcagggagggaggtgggggggtcagccccccgccaggccagccgccccgtccgggagggaggtcggggcgtcagcctcccgcccggccagccgccccgtccgggaggtgaggggc

SEQ ID NO: 2297 - DNA, 454 bp, Artificial Sequence
  Synthetic polypeptide
atgcaggctgtgagaaacgcggggtcgcggttcctgcggtcctggacttggccccagacagccggcagggtcgtggccagaacgccggccgggaccatctgcacaggcgctcgacagctccaagacgctgcggccaagcagaaagttgaacagaacgcggctcccagccacaccaagttcagcactttaggcggccaaggtgggcgaattacttgaggtcaggagatcgagaccagcctggccaacatggcgaaaccccgtctccactaaaagcacaaaaactagccaggcgtgatgtctggcacctgtaatcccagccactcaggaggctgaagtagaagaatcgcatgaacccagggagcggaggttgcagtgagccaagatcacgccactgtactccagcctgggtgacagattgagactctgtctcaaagaaaaaaaaaaaaaaaaagaa

SEQ ID NO: 2298 - DNA, 496 bp, Artificial Sequence
  Synthetic polypeptide
atggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtctttggatggaaagtttgagaaccactg

SEQ ID NO: 2299 - DNA, 607 bp, Artificial Sequence
  Synthetic polypeptide
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggattcccagaggatgacatgaagttggaagagataccatcagatgacagagttgggattcaagaagatcccagcagactagaacaatgagccaaacaagatcagaactgagtggggata

SEQ ID NO: 2300 - DNA, 577 bp, Artificial Sequence
  Synthetic polypeptide
tctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggattcccagaggatgacatgaagttggaagagataccatcagatgacagagttgggattcaagaagatcccagcagactagaacaatgagccaaacaagatcagaactgagtggggata

SEQ ID NO: 2301 - DNA, 604 bp, Artificial Sequence
  Synthetic polypeptide
atggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggattcccagaggatgacatgaagttggaagagataccatcagatgacagagttgggattcaagaagatcccagcagactagaacaatgagccaaacaagatcagaactgagtggggata

SEQ ID NO: 2302 - DNA, 678 bp, Artificial Sequence
  Synthetic polypeptide
atgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccattgttggtcagtctctgttacttgcaaccaaaatcatccctaactgacaca

SEQ ID NO: 2303 - DNA, 771 bp, Artificial Sequence
  Synthetic polypeptide
atgggagcagcccaggggaagaagaaaacatactctcctcaggccagatttcatagtgaaaatgagaagcagagacgaaatggctcagccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccattgttggtcagtctctgttacttgcaaccaaaatcatccctaactgacaca

SEQ ID NO: 2304 - DNA, 762 bp, Artificial Sequence
  Synthetic polypeptide
atggcgcagaggctgggcgagtgggcccgggggccctccgatgccaccgggctctaccgggctgtgctgctccggtcggccgccatgtactcggagatccagagggagcgggcagacattgggggcctgatggcccggccagaatacagagagtggaatccggagctcatcaagcccaagaagctgctgaaccccgtgaaggcctctcggagtcaccaggagctccaccgggagctgctcatgaaccacagaaggggccttggtgtggacagcaagccagagctgcagcgtgtcctagagcaccgccggcggaaccagctcatcaagaagaagaaggaggagctggaagccaagcggctgcagtgcccctttgagcaggagctgctgagacggcagcagaggctgaaccagcttaggatggctatgtgatcaggtgtggccaatgaaattgaagaggaagtctacctgggcttctgggaaagcttttccaataaaagacacaggcatggctaacacctccctgggcctcttcttcctaccttgattgagggtgtgatgcctggagccacagcagccactttgctaccatgacaaaaaggccaagagaatcacagagtcattgaccctatcattatttcaccaagccaataccagccgccatccttctccagaattcttgtaaataaaataaatccctctttgtttaaaccattgttggtcagtctctgttacttgcaaccaaaatcatccctaactgacaca

SEQ ID NO: 2305 - DNA, 696 bp, Artificial Sequence
  Synthetic polypeptide
atgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcggctgacctgaagatgacaaaaggccagaagactccttggcttacttcgtccgaccacccggcaccctcctcctcatgtttatggttccaacctgacaacaaccctggaccacagagacctcttcctggacgactgccaacttcaggccagtttggaccggttccctgagactgcacagatcctggacttgtgccctaagcatcacctttttgcatttatgacccaattgtagtacatttaaatgttaaatctccaccccaaagtgaacatgagtagcatattgttgtatgttccgtgcacatgtaagcctaatgcacgtgcgtaatgagttttctccgtaaatattcacaaccttctcctatatcctgtagaatatgcgtttcctacctcctcacctagcagaaatatctgccttattttctccccttcaaagcctgcttctcagtctcagttgaaagcttgcttcctgcctgcaggttgtgtcctttagaaataaagttctcttttgattttgtggattctgactctttttcagttgaca

SEQ ID NO: 2306 - DNA, 207 bp, Artificial Sequence
  Synthetic polypeptide
atgaacaaaaaccagttgcgaaatggtctgaggcagagtgtggttcagcttataggtggaagggacttgccttttctcagatgagactttggactgtggacttttgagttaatgctgaaatgagttaagactttgggggcctgttgggatggcatgattggttttgaaatgtgaggacatgagatttgggaaggtccaggggcagaa

SEQ ID NO: 2307 - DNA, 522 bp, Artificial Sequence
  Synthetic polypeptide
atggcggacggcggcggcggcgggggaactggcgcggtgggcggcggcggaactagccaggcctctgccggggcagcgactggcgctactggggccagcgggggcggtggccccatcaacccggcctcgctgcctcccggcgacccgcagctcatcgctctcatcgtggagcagctcaagagccggggcctttttgacagcttccgccgggactgcctggccgacgtggacaccaagccagcttaccaaaacctgaggcagaaagtggataattttgtgtcaacacatctggacaagcaggaatggaatcctacgatgaacaaaaaccagttgcgaaatggtctgaggcagagtgtggttcagcttataggtggaagggacttgccttttctcagatgagactttggactgtggacttttgagttaatgctgaaatgagttaagactttgggggcctgttgggatggcatgattggttttgaaatgtgaggacatgagatttgggaaggtccaggggcagaa

SEQ ID NO: 2308 - DNA, 154 bp, Artificial Sequence
  Synthetic polypeptide
atgagtgataaaccagacttgtcggaagtggagaagtttgacaggtcaaaactgaagaaaactaatactgaagaaaaaaatactcttccctcaaaggaaaaacttcattatgtgcgatatggcaagagagaaagtgaatacgctgatataagaa

SEQ ID NO: 2309 - DNA, 359 bp, Artificial Sequence
  Synthetic polypeptide
atgatacctggaattgggacactcacccaggacacactatggtgcttcagccaagtgaaaggcactatcgagattggaaccacagaagagagacactcaggaagaagatggccatgcaactggggaggcggagaccggagtgaggcatctacaagccaaagaatgccaagattggcagcaaacaccaaaagctggaagaagcaataaaaggttctcctctacaggtttcagagggtggttgcccctgccaacaccttgatttcagacttctagtccccagaactgtgaaagaataaatgcctgtcatttaagacacctagtttgtgactttgttatggcagccctaagaaaccaacaca

SEQ ID NO: 2310 - DNA, 321 bp, Artificial Sequence
  Synthetic polypeptide
atggtgcttcagccaagtgaaaggcactatcgagattggaaccacagaagagagacactcaggaagaagatggccatgcaactggggaggcggagaccggagtgaggcatctacaagccaaagaatgccaagattggcagcaaacaccaaaagctggaagaagcaataaaaggttctcctctacaggtttcagagggtggttgcccctgccaacaccttgatttcagacttctagtccccagaactgtgaaagaataaatgcctgtcatttaagacacctagtttgtgactttgttatggcagccctaagaaaccaacaca

SEQ ID NO: 2311 - DNA, 681 bp, Artificial Sequence; identical to SEQ ID NO: 1642
  Synthetic polypeptide

SEQ ID NO: 2312 - DNA, 534 bp, Artificial Sequence; identical to SEQ ID NO: 1643
  Synthetic polypeptide

SEQ ID NO: 2313 - DNA, 270 bp, Artificial Sequence; identical to SEQ ID NO: 1644
  Synthetic polypeptide

SEQ ID NO: 2314 - DNA, 596 bp, Artificial Sequence; identical to SEQ ID NO: 1645
  Synthetic polypeptide

SEQ ID NO: 2315 - DNA, 1200 bp, Artificial Sequence
  Synthetic polypeptide
atggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggacatggatgaagctggaaaccatcattctcagcaaactatcgcaaggacaaaaaaacaaacagcgcatgttctcactcatggatgggaattgaacaatgagaacacttggacacaggaaggggaacatcacacaccggggcctgttgtggggtggggggaggggggagggatagcattaggagatatacctaatgtaaatgacgagttaatgggtgcagcacaccaacgtggcacatgtatacatatgtaacaaacctgcacgttgtgcacatgtaccctagaacttaaagtattata

SEQ ID NO: 2316 - DNA, 787 bp, Artificial Sequence
  Synthetic polypeptide
atgccgctgggcctgaagcccacctgcagcgtatgcaagaccacgtcgtcctccatgtggaagaagggagcgcagggggagatcctctgccatcattgcactggccggggcggcgcgggcagcgggggcgcaggctcgggggcggctggagggactgggggcagcggcggcggcggcttcggcgcggcgaccttcgccagcacctccgccacccctccgcagagcaacgggggcgggggcggcaagcagagtaagcaggaaattcacaggaggtctgctcggctcagaaacactaaatacaaatctgctccggctgctgaaaagaaagtctccaccaaaggaaaagggagaagacatatatttaaattgaaaaatcccatcaaagctcctgagtcagtttccactataatcactgcagaatcaatcttctacaagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcatagactgcctgcgctgctgacttaaggccccaacaccaaacacagaagcaacagccttacacagagtgttcagcaagctccaacaattgtgtaaggtaaagtttcctttatagattccttttctatatcgctcctagtggttctgtttctctgatcgaattctggctgata

SEQ ID NO: 2317 - DNA, 403 bp, Artificial Sequence
  Synthetic polypeptide
atgggcgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2318 - DNA, 688 bp, Artificial Sequence
  Synthetic polypeptide
atggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2319 - DNA, 757 bp, Artificial Sequence
  Synthetic polypeptide
atgggcggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2320 - DNA, 547 bp, Artificial Sequence
  Synthetic polypeptide
aaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2321 - DNA, 256 bp, Artificial Sequence
  Synthetic polypeptide
tttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2322 - DNA, 622 bp, Artificial Sequence
  Synthetic polypeptide
atggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2323 - DNA, 343 bp, Artificial Sequence
  Synthetic polypeptide
atggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggttttgggacttggactgccttccttgctcctcagcttgcagacggcctattgtgggacctcaccctgtgatcatgtgggtcaatacttaaactctcctttatttaaacatctatcctattagttctgtccctctagaataccctaa

SEQ ID NO: 2324 - DNA, 1314 bp, Artificial Sequence
  Synthetic polypeptide
atggttggaaagctgaagcagaacttactattggcatgtctggtgattagttctgtgactgtgttttacctgggccagcatgccatggaatgccatcaccggatagaggaacgtagccagccagtcaaattggagagcacaaggaccactgtgagaactggcctggacctcaaagccaacaaaacctttgcctatcacaaagatatgcctttaatatttattggaggtgtgcctcggagtggaaccacactcatgagggccatgctggacgcacatcctgacattcgctgtggagaggaaaccagggtcattccccgaatcctggccctgaagcagatgtggtcacggtcaagtaaagagaagatccgcctggatgaggctggtgttactgatgaagtgctggattctgccatgcaagccttcttactagaaattatcgttaagcatggggagccagccccttatttatgtaataaagatccttttgccctgaaatctttaacttacctttctaggttattccccaatgccaaatttctcctgatggtccgagatggccgggcatcagtacattcaatgatttctcgaaaagttactatagctggatttgatctgaacagctatagggactgtttgacaaagtggaatcgtgctatagagaccatgtataaccagtgtatggaggttggttataaaaagtgcatgttggttcactatgaacaacttgtcttacatcctgaacggtggatgagaacactcttaaagttcctccagattccatggaaccactcagtattgcaccatgaagagatgattgggaaagctgggggagtgtctctgtcaaaagtggagagatctacagaccaagtaatcaagccagtcaatgtaggagctctatcaaaatgggttgggaagataccgccagatgttttacaagacatggcagtgattgctcctatgcttgccaagcttggatatgacccatatgccaacccacctaactacggaaaacctgatcccaaaattattgaaaacactcgaagggaacagaaaaccagataccacgtgttctcacttataagggggcactaaatgatgagaacacatggacacatggcggagaacaagacactggggtgtactggagggtggagggtggaggagggagaggatcaggaaacataactaatgggtactaggcttaatacctgggtgatgaaataatctgtacagcaaacccccatgacatgagtttacctatagaacaaaactgtacatgttcccctgaacttaaaataaaagttaacaaaaaaa

SEQ ID NO: 2325 - DNA, 840 bp, Artificial Sequence; identical to SEQ ID NO: 1937
  Synthetic polypeptide

SEQ ID NO: 2326 - DNA, 1673 bp, Artificial Sequence
  Synthetic polypeptide
atggcgcggggggacgccggccgcggccgcgggctcctcgcgttgaccttctgcctgttggccgcgcgcggggagctgctgttgccccaggagacgactgtggagctgagctgtggagtggggccactgcaagtgatcctgggcccagagcaggctgcagtgctaaactgtagcctgggggctgctgccgctggaccccccaccagggtgacctggagcaaggatggggacaccctgctggagcacgaccacttacacctgctgcccaatggttccctgtggctgtcccagccactagcacccaatggcagtgacgagtcagtccctgaggctgtgggggtcattgaaggcaactattcgtgcctagcccacggccccctcggagtgctggccagccagactgctgtcgtcaagcttgccacactcgcagacttctctctgcacccggagtctcagacggtggaggagaacgggacagctcgctttgagtgccacattgaagggctgccagctcccatcattacttgggagaaggaccaggtgacattgcctgaggagcctcggctcatcgtgcttcccaacggcgtccttcagatcctggatgttcaggagagtgatgcaggcccctaccgctgcgtggccaccaactcagctcgccagcacttcagccaggaggccctactcagtgtggcccacagagggtccctggcgtccaccagggggcaggacgtggtcattgtggcagccccagagaacaccacagtggtgtctggccagagtgtggtgatggaatgtgtggcctcagctgaccccaccccttttgtgtcctgggtccgacaagacgggaagcccatctccacagatgtcatcgtcctgggccgcaccaacctactaattgccaacgcgcagccctggcactccggcgtctatgtctgccgcgccaacaagccccgcacgcgcgacttcgccactgcagccgctgagctccgtgtgctggcggctcccgccatcactcaggcgcccgaggcgctgtcgcggacgcgggcgagcacagcgcgcttcgtgtgccgcgcgtcgggggagccgcggccagcgctgcgctggctgcacaacggggcgccgctgcggcccaacgggcgcgtcaaggtccagggcggcggtggcagcctggtcatcacacagatcggcctgcaggacgccggctactaccagtgcgtggctgagaacagcgcgggaatggcgtgcgctgccgcgtcgctggccgtggtggtgcgcgaggggctgcccagcgcccccacgcgggtcactgctacgccactgagcagctccgctgtgttggtggcctgggagcggcccgagatgcacagcgagcagatcatcggcttctctctccactaccagaaggcacggggcatggacaatgtggaataccagtttgcagtgaacaacgacaccacagaactacaggttcgggacctggaacccaacacagattatgagttctacgtggtggcctactcccagctgggagccagccgcacctccaccccagcactggtgcacacactggatgatgatcctggtcctggcctacttctgacttgctgtgtgacccaggcaagtctctgaccgctcccgagcctcaccttccacgtcggtggagcagagctcat

SEQ ID NO: 2327 - DNA, 3220 bp, Artificial Sequence; identical to SEQ ID NO: 248
  Synthetic polypeptide

SEQ ID NO: 2328 - DNA, 651 bp, Artificial Sequence
  Synthetic polypeptide
atggaacagcctgggcccagggctccggatccctctctctgccaccacaacctccagccaacagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagaaatcctggatgctagaagacatttggaaaaatgtgttgaagggaagtgatttccaacctaaaattctatatccagccaaactatcaagcaagtctaatgaagaaaaaaagacatttccagattgacaagaatatactttcaaaagttcctccaacacaccctttcttaggaagctactgga

SEQ ID NO: 2329 - DNA, 1150 bp, Artificial Sequence
  Synthetic polypeptide
atgctggtgccgctagccaagctgtcctgcctggcatatcagtgctttcatgccttaaaaattaagaaaaattatctacctctatgtgctacaagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcaggaagagtgagagggaaaggatgcagtccaagtgg

SEQ ID NO: 2330 - DNA, 1009 bp, Artificial Sequence
  Synthetic polypeptide
atgctggtgccgctagccaagctgtcctgcctgggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcaggaagagtgagagggaaaggatgcagtccaagtgg

SEQ ID NO: 2331 - DNA, 451 bp, Artificial Sequence; identical to SEQ ID NO: 339
  Synthetic polypeptide

SEQ ID NO: 2332 - DNA, 569 bp, Artificial Sequence; identical to SEQ ID NO: 1768
  Synthetic polypeptide

SEQ ID NO: 2333 - DNA, 497 bp, Artificial Sequence; identical to SEQ ID NO: 1769
  Synthetic polypeptide

SEQ ID NO: 2334 - DNA, 976 bp, Artificial Sequence
  Synthetic polypeptide
atgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2335 - DNA, 1009 bp, Artificial Sequence
  Synthetic polypeptide
atggaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2336 - DNA, 1132 bp, Artificial Sequence
  Synthetic polypeptide
atgcaggtttgcagccagccccaaagggggtgtgtgcgcgagcagagcgctataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2337 - DNA, 563 bp, Artificial Sequence
  Synthetic polypeptide
ccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccatagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggcctgggaaacaagagcgaaattctgtctcaaaaaaaagacaa

SEQ ID NO: 2338 - DNA, 387 bp, Artificial Sequence
  Synthetic polypeptide
atgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagggaaaggaaatctggacacagataggtacagaaggaagaccatgtgaagacacagggagaagatgactatctacatgccaaggagagaggccttcaaaatggccaatcctgctgacacttttatcttggacttctaacctccagaattgtgagacaataaatttctgccatttagagacccagtctgtgttactttattatggcagccctagcaaactgataca

SEQ ID NO: 2339 - DNA, 1358 bp, Artificial Sequence
  Synthetic polypeptide
atggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccaggaggagcgggcgctgccccttgctacgacgcggatgggccgcggggacgtcacgctcagtggagggagccagacggggaaggccgtgcagcttgcgatgcccttggcaggaaatgcccggggcggggaagtccgtggagccccgtacaccctggcggtggccagggcctgggggaccaggaaccaggagcgcctgctgaacgtcgggggtaggagggggtttatttgggggcgacgaagaggtgtggagttagataggggcagtggtcgcacagcactgtgtgtgcaggcgctactgaagtgcacgctttaacatggctaacatggtgaacttca

SEQ ID NO: 2340 - DNA, 1332 bp, Artificial Sequence
  Synthetic polypeptide
atgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcaggaagctactggagtgtggtgtctaccacaacaagggagtactctaagaaggaggatcagatccagggaagaggggctcccatacaagacaggggagcagaatccccaggaagttgacaggtgcaagtcccaggacagcagtgtcacagaagacctggaaagcagccaattatggagagtcgcctccagggaaagcaaagtcatagtagatttgaccatgtggaaaatcttatcgagagactttttacagagctgttggtgggtatgaaaaagcttaggtactggtttaaagaaaactaagcaaataaaatgtgagaaagttactccaggaaaaactaaaaggtgtaaaagaatatctgtaattcagtgtatttcctgtttcaggagcaaacaatatttgcatagtatagtctgtaaagaacacaggattatggatggtgaccagagtgaaactaaaaatggtgaccagagtgaaattctcttgggaagatcagaggaaggaaagtgt

SEQ ID NO: 2341 - DNA, 501 bp, Artificial Sequence
  Synthetic polypeptide
atggaagagcctgcagctccctcagaagcccacgaggcagccggggcccaggcaggtgctgaggcagcaagggagggtgtgtctgggccggaccttcccgtctgtgagccctccggggaatctgctgctccagattcagccctgccacatgcggcaaggggctgggcccccttccctgtagctccagtccctgcccacctccgcagaggaggcctgaggcctgccccagcctcaggaggaggagcctggcccagtccgttgccaagccgaagcagcggcatttggacaaagcagatcatctgcaggtgaacggcatggattctgagaaccaggaagagagccaagtcataaaaggatcggtgcccgagtgagtccttgaatggttcatggaacagaacttctcagtcttcactcccctttacccatactgaagtttacatgattaatataatgtaatatataactaagccactgagatttgcgagtttctttgattgcagc

SEQ ID NO: 2342 - DNA, 1206 bp, Artificial Sequence; identical to SEQ ID NO: 282
  Synthetic polypeptide

SEQ ID NO: 2343 - DNA, 1209 bp, Artificial Sequence; identical to SEQ ID NO: 281
  Synthetic polypeptide

SEQ ID NO: 2344 - DNA, 1203 bp, Artificial Sequence; identical to SEQ ID NO: 286
  Synthetic polypeptide

SEQ ID NO: 2345 - DNA, 573 bp, Artificial Sequence; identical to SEQ ID NO: 1369
  Synthetic polypeptide

SEQ ID NO: 2346 - DNA, 416 bp, Artificial Sequence; identical to SEQ ID NO: 1370
  Synthetic polypeptide

SEQ ID NO: 2347 - DNA, 128 bp, Artificial Sequence; identical to SEQ ID NO: 144
  Synthetic polypeptide

SEQ ID NO: 2348 - DNA, 821 bp, Artificial Sequence
  Synthetic polypeptide
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2349 - DNA, 656 bp, Artificial Sequence
  Synthetic polypeptide
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2350 - DNA, 780 bp, Artificial Sequence
  Synthetic polypeptide
atgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2351 - DNA, 439 bp, Artificial Sequence
  Synthetic polypeptide
ggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggaatctacttaatagggctatcatggggataaaatgagtgcatatatttaaggtaattttttaacgggtctggcacatagtaagtgctcaataaagattagcttttact

SEQ ID NO: 2352 - DNA, 917 bp, Artificial Sequence
  Synthetic polypeptide
atggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggattagcctgatacggtggtgcatgcctgtagttcaggctactcaggaggctgaggcgggaggatcgcttgagcctaggagttggaggctgcagtgaactatgatggtgccactgcactccagcctgggtgacagagcgagaccttatctccaaaaattaaaaaa

SEQ ID NO: 2353 - DNA, 657 bp, Artificial Sequence; identical to SEQ ID NO: 180
  Synthetic polypeptide

SEQ ID NO: 2354 - DNA, 423 bp, Artificial Sequence; identical to SEQ ID NO: 179
  Synthetic polypeptide

SEQ ID NO: 2355 - DNA, 415 bp, Artificial Sequence
  Synthetic polypeptide
atgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccggaagaggaaatttggacacagacatgcacagacaagagggacaaccacagaaagacacagggagaagagggccatctgtgagccaaggagagaagccccaagagccaaccctaccgacaccttgatcttagacttttagcctccggaattgtgagacaatatatgtctgttgtttatgccaccgaacccacgttattttatcatggtagcccctagcaaactcat

SEQ ID NO: 2356 - DNA, 259 bp, Artificial Sequence
  Synthetic polypeptide
atgtgtcagaaagaagtgatggagcaaagtgccggaagaggaaatttggacacagacatgcacagacaagagggacaaccacagaaagacacagggagaagagggccatctgtgagccaaggagagaagccccaagagccaaccctaccgacaccttgatcttagacttttagcctccggaattgtgagacaatatatgtctgttgtttatgccaccgaacccacgttattttatcatggtagcccctagcaaactcat

SEQ ID NO: 2357 - DNA, 809 bp, Artificial Sequence; identical to SEQ ID NO: 2110
  Synthetic polypeptide

SEQ ID NO: 2358 - DNA, 644 bp, Artificial Sequence; identical to SEQ ID NO: 2111
  Synthetic polypeptide

SEQ ID NO: 2359 - DNA, 768 bp, Artificial Sequence; identical to SEQ ID NO: 2112
  Synthetic polypeptide

SEQ ID NO: 2360 - DNA, 427 bp, Artificial Sequence; identical to SEQ ID NO: 2113
  Synthetic polypeptide

SEQ ID NO: 2361 - DNA, 980 bp, Artificial Sequence; identical to SEQ ID NO: 139
  Synthetic polypeptide

SEQ ID NO: 2362 - DNA, 1256 bp, Artificial Sequence; identical to SEQ ID NO: 140
  Synthetic polypeptide

SEQ ID NO: 2363 - DNA, 1277 bp, Artificial Sequence; identical to SEQ ID NO: 142
  Synthetic polypeptide

SEQ ID NO: 2364 - DNA, 303 bp, Artificial Sequence; identical to SEQ ID NO: 148
  Synthetic polypeptide

SEQ ID NO: 2365 - DNA, 301 bp, Artificial Sequence; identical to SEQ ID NO: 147
  Synthetic polypeptide

SEQ ID NO: 2366 - DNA, 857 bp, Artificial Sequence; identical to SEQ ID NO: 1374
  Synthetic polypeptide

SEQ ID NO: 2367 - DNA, 2849 bp, Artificial Sequence; identical to SEQ ID NO: 1326
  Synthetic polypeptide

SEQ ID NO: 2368 - DNA, 1925 bp, Artificial Sequence; identical to SEQ ID NO: 1327
  Synthetic polypeptide

SEQ ID NO: 2369 - DNA, 2729 bp, Artificial Sequence; identical to SEQ ID NO: 1328
  Synthetic polypeptide

SEQ ID NO: 2370 - DNA, 2549 bp, Artificial Sequence; identical to SEQ ID NO: 1329
  Synthetic polypeptide

SEQ ID NO: 2371 - DNA, 561 bp, Artificial Sequence
  Synthetic polypeptide
atgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagctgtaacactcactgcaacgggctgcagcttcgctcctgaggccagcgagaccacgaacccattggaagaatgaacaactccagacgcgctgccttatgagctgcaacactcaccgcgaaggtctgtagcttcactcctgaagccagtgagaccatgaacccgccagaagaaagaaactccgaacacgtctgaatatcagaaggaacaacctccggacacaccacctttaagaactgtaacactcaccgcgagggtctgcagcttcattcttgaagtcagtgagaccaagaatccaccaattccggagac

SEQ ID NO: 2372 - DNA, 1052 bp, Artificial Sequence; identical to SEQ ID NO: 247
  Synthetic polypeptide

SEQ ID NO: 2373 - DNA, 327 bp, Artificial Sequence; identical to SEQ ID NO: 246
  Synthetic polypeptide

SEQ ID NO: 2374 - DNA, 7189 bp, Artificial Sequence
  Synthetic polypeptide
atgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccctggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggaaccatgcaagaagcgcagccaccagaagtccttaaaacagcaggaaaggtgtctacggagaaataaacaagtgatgcacgacagatacatgtgtcagtctggtccctgcagttgtatttgtaataatacacattggagcaatttcatggccatcagttagagaatgtttgaggaatgatccattcata

SEQ ID NO: 2375 - DNA, 671 bp, Artificial Sequence
  Synthetic polypeptide
atggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgctgttcagaggcagaggcaggagaatcatttgaatgcgggagacagaggctgcagtaagccgagatcgtgccactgcactccagcctgggtgacacagcgagactctgtctcaaaaagaaagaaagagagagagagaaa

SEQ ID NO: 2376 - DNA, 353 bp, Artificial Sequence
  Synthetic polypeptide
cgcttcgccgagggcatccgccacatgaagagccggctggccgcgctgcagaactctgtgggcagggtgggcccagatgcccttccaggtatcagtgaatgctccagccagccttgtcaaaatggtggtacatgtgtagaaggagtcaaccagtacagatgcatttgtcctccaggaaggactgggaaccgctgtcagcatcaggcccagactgctgttcagaggcagaggcaggagaatcatttgaatgcgggagacagaggctgcagtaagccgagatcgtgccactgcactccagcctgggtgacacagcgagactctgtctcaaaaagaaagaaagagagagagagaaa

SEQ ID NO: 2377 - DNA, 2962 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2378 - DNA, 2899 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaagcaggcccttctgaaactgatgatgttgatgaaaaacagcccctatcgaagcctttgcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2379 - DNA, 2902 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagattctactcaacatgtcccttcagaaacaagtgaggaccctgaagttgaggtgactattgaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2380 - DNA, 2839 bp, Artificial Sequence
  Synthetic polypeptide
atggcccaagttgcaatgtccaccctccccgttgaagatgaggagtcctcggagagcaggatggtggtgacattcctcatgtcagctctcgagtccatgtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtgttgaagaagaagaaaaagctgcagagatgcataaaatgaaatctacaacccaggcaaatcggatgagtgtagatgctgtagaaattgaaacactcagaaaaacagttgaggactatttctgcttttgctatgggaaagctttaggcaaatccacagtggtacctgtaccatatgagaagatgctgcgagaccagtcggctgtggtagtgcaggggcttccggaaggtgttgcctttaaacaccccgagaactatgatcttgcaaccctgaaatggattttggagaacaaagcagggatttcattcatcattaagagaccttttttagagccaaagaagcatgtaggtggtcgtgtgatggtaacagatgctgacaggtcaatactatctccaggtggaagttgtggccccatcaaagtgaaaactgaacccacagaagattctggcatttccctggaaatggcagctgtgacagtaaaggaagaatcagaagatcctgattattatcaatataacattcaaggaagccaccattcttcagagggcaatgaaggcacagaaatggaagtaccagcagaagatgatgattattctccaccgtctaagagaccaaaggccaatgagctaccgcagccaccagtcccggaacccgccaatgctgggaagcggaaagtgagggagttcaacttcgagaaatggaatgctcgcatcactgatctacgtaaacaagttgaagaattgtttgaaaggaaatatgctcaagccataaaagccaaaggtccggtgacgatcccgtaccctcttttccagtctcatgttgaagatctttatgtagaaggacttcctgaaggaattccttttagaaggccatctacttacggaattcctcgcctggagaggatattacttgcaaaggaaaggattcgttttgtgattaagaaacatgagcttctgaattcaacacgtgaagatttacagcttgataagccagcttcaggagtaaaggaagaatggtatgccagaatcactaaattaagaaagatggtggatcagcttttctgcaaaaaatttgcggaagccttggggagcactgaagccaaggctgtaccgtaccaaaaatttgaggcacacccgaatgatctgtacgtggaaggactgccagaaaacattcctttccgaagtccctcatggtatggaatcccaaggctggaaaaaatcattcaagtgggcaatcgaattaaatttgttattaaaagaccagaacttctgactcacagtaccactgaagttactcagccaagaacgaatacaccagtcaaagaagattggaatgtcagaattaccaagctacggaagcaagtggaagagatttttaatttgaaatttgctcaagctcttggactcaccgaggcagtaaaagtaccatatcctgtgtttgaatcaaacccggagttcttgtatgtggaaggcttgccagaggggattcccttccgaagccctacctggtttggaattccacgacttgaaaggatcgtccgcgggagtaataaaatcaagttcgttgttaaaaaacctgaactagttatttcctacttgcctcctgggatggctagtaaaataaacactaaagctttgcagtcccccaaaagaccacgaagtcctgggagtaattcaaaggttcctgaaattgaggtcaccgtggaaggccctaataacaacaatcctcaaacctcagctgttcgaaccccgacccagactaacggttctaacgttcccttcaagccacgagggagagagttttcctttgaggcctggaatgccaaaatcacggacctaaaacagaaagttgaaaatctcttcaatgagaaatgtggggaagctcttggccttaaacaagctgtgaaggtgccgttcgcgttatttgagtctttcccggaagacttttatgtggaaggcttacctgagggtgtgccattccgaagaccatcgacttttggcattccgaggctggagaagatactcagaaacaaagccaaaattaagttcatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagagtcttcctgaaacacagctacacccgtattatccatggctgctttcctgtcacagtgagtaagtagctgggactgagaaggcatggcctccaaagtctaaaatatttactctctagcactttgtagaaaaacctta

SEQ ID NO: 2381 - DNA, 664 bp, Artificial Sequence
  Synthetic polypeptide
atggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagtgagtcgaagcagcccgaggtcctcaccatatgcagatgctcagta

SEQ ID NO: 2382 - DNA, 3733 bp, Artificial Sequence
  Synthetic polypeptide
atgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagcctcctcccttctactcctcctccttctccttcctcttccccttgctcttcctcctcccttccactcctcctcttttctcctccccattcatctcccactcttccccctcctccctccaactcctcccctcctccttccattcatctttctcctcctttctccttcccttcctcctccctcttctctccttcctccctcccattcctctgcctcctccttccactcatcttcctcctcctttctcttccccatcctccctcccactcctccccctccttcttccactgatctttctcctcctttctcctccccctcctcctcc

SEQ ID NO: 2383 - DNA, 2086 bp, Artificial Sequence
  Synthetic polypeptide
atgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagcctcctcccttctactcctcctccttctccttcctcttccccttgctcttcctcctcccttccactcctcctcttttctcctccccattcatctcccactcttccccctcctccctccaactcctcccctcctccttccattcatctttctcctcctttctccttcccttcctcctccctcttctctccttcctccctcccattcctctgcctcctccttccactcatcttcctcctcctttctcttccccatcctccctcccactcctccccctccttcttccactgatctttctcctcctttctcctccccctcctcctcc

SEQ ID NO: 2384 - DNA, 477 bp, Artificial Sequence
  Synthetic polypeptide
agggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagcctcctcccttctactcctcctccttctccttcctcttccccttgctcttcctcctcccttccactcctcctcttttctcctccccattcatctcccactcttccccctcctccctccaactcctcccctcctccttccattcatctttctcctcctttctccttcccttcctcctccctcttctctccttcctccctcccattcctctgcctcctccttccactcatcttcctcctcctttctcttccccatcctccctcccactcctccccctccttcttccactgatctttctcctcctttctcctccccctcctcctcc

SEQ ID NO: 2385 - DNA, 585 bp, Artificial Sequence
  Synthetic polypeptide
atggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcagggacaaaaaagaaagaagtttaaatggaagcaggaaaggttgagatttgggatgagaatgaactgccagaagagacagcaaaaggaccggaataag

SEQ ID NO: 2386 - DNA, 579 bp, Artificial Sequence
  Synthetic polypeptide
atggcgacagcctctcccgctgctgacggggggcgggggcggccctgggaaggagggctggtctcctggccccccgcccctccccttactctcccctggacttggatgggcccgagttgggggcaacaccccgggcattggggctttccagctctcacagaaccttcagcatccccagctgccggtcttggcatcttcgaagtaaggagagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcagggacaaaaaagaaagaagtttaaatggaagcaggaaaggttgagatttgggatgagaatgaactgccagaagagacagcaaaaggaccggaataag

SEQ ID NO: 2387 - DNA, 436 bp, Artificial Sequence
  Synthetic polypeptide
atgcctgagatcagagtcacgcccttgggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2388 - DNA, 454 bp, Artificial Sequence
  Synthetic polypeptide
atgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2389 - DNA, 349 bp, Artificial Sequence
  Synthetic polypeptide
atgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2390 - DNA, 577 bp, Artificial Sequence
  Synthetic polypeptide
atgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2391 - DNA, 439 bp, Artificial Sequence
  Synthetic polypeptide
atgcctgagatcagagtcacgcccttggtaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2392 - DNA, 616 bp, Artificial Sequence
  Synthetic polypeptide
atgcctgagatcagagtcacgcccttgggtgcctgccctgtgctgtcctggaacctggtccttccaccgggcagggggtcgagggcaccttccagcacagacaccaggacgggattccatgtcctcccccatggccccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagctccactcagcctgtcctgactgcctgaaaagccagcggctcccctatgcgcggttccctcagcagctttgcattgtctcgcgagcatgtcgccgtcaccgacgtgttcaatttcccgtttgcttattgccttgctagactttgagactgaaagttccagggagacagttttgtgtttgctcattactgactcttcggtactcgggatgaggcctggcgcacagcaggcgaatgaa

SEQ ID NO: 2393 - DNA, 565 bp, Artificial Sequence; identical to SEQ ID NO: 1420
  Synthetic polypeptide

SEQ ID NO: 2394 - DNA, 610 bp, Artificial Sequence; identical to SEQ ID NO: 163
  Synthetic polypeptide

SEQ ID NO: 2395 - DNA, 193 bp, Artificial Sequence; identical to SEQ ID NO: 975
  Synthetic polypeptide

SEQ ID NO: 2396 - DNA, 822 bp, Artificial Sequence; identical to SEQ ID NO: 119
  Synthetic polypeptide

SEQ ID NO: 2397 - DNA, 434 bp, Artificial Sequence; identical to SEQ ID NO: 992
  Synthetic polypeptide

SEQ ID NO: 2398 - DNA, 371 bp, Artificial Sequence; identical to SEQ ID NO: 1008
  Synthetic polypeptide

SEQ ID NO: 2399 - DNA, 272 bp, Artificial Sequence; identical to SEQ ID NO: 1009
  Synthetic polypeptide

SEQ ID NO: 2400 - DNA, 157 bp, Artificial Sequence; identical to SEQ ID NO: 1500
  Synthetic polypeptide

SEQ ID NO: 2401 - DNA, 39 bp, Artificial Sequence
  Synthetic polypeptide
atggggaggcccacccagatctgaaaatgtctaatttca

SEQ ID NO: 2402 - DNA, 840 bp, Artificial Sequence
  Synthetic polypeptide
atggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacaacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccaggtgtagtggtgtgtgcctacagtcccagctactcgggagactgaagtaggaggatcactgcactccagcctgagcaacagaacaagacccaatctctaacaatagtaataataa

SEQ ID NO: 2403 - DNA, 1424 bp, Artificial Sequence
  Synthetic polypeptide
atgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagcaccgggtcctggccatctctgacgggatcgagcacatcgggaaccttcgctgggagctggccttgtgtctcttggcagcctggaccatctgttacttctgtatctggaaggggaccaagtctacaggaaaggttgtatacgtgactgcgacattcccctacatcatgctgctgatcctcctgatacgaggggtcacgttgcccggggcctcagagggcatcaagttctacttgtaccctgacctctcccggctctccgacccccaggtctgggtagatgctggaacgcagatctttttctcctatgccatttgcctgggctgtctgaccgctctgggaagttataacaattataacaacaactgctacagggactgcatcatgctctgttgcctgaacagcggcaccagcttcgtggctgggtttgccatcttctcagtcctgggttttatggcgtacgagcagggggtacccattgctgaggtggcagagtcagccaaaagatgcacaacctcaccataagtcatgaggaaacatcagaccaacccacatcaagagacattctgcaaaacaacaaccagaactcatcaaaaatgttgagtttagcaaagaccaaaaaaagactaagggactgccacagactggagaagactaaagagatacaaccaataaacgcaatgtggagttctgaattaaatgttggaacagaaaaaaagggggcaaaaggagaaaaactggcagaatatgaataagctctgtggcgtaattaatggtattataccaatattaatttaccagtt

SEQ ID NO: 2404 - DNA, 1146 bp, Artificial Sequence; identical to SEQ ID NO: 988
  Synthetic polypeptide

SEQ ID NO: 2405 - DNA, 1221 bp, Artificial Sequence; identical to SEQ ID NO: 122
  Synthetic polypeptide

SEQ ID NO: 2406 - DNA, 1753 bp, Artificial Sequence
  Synthetic polypeptide
atgtggcgctggatccggcagcagctgggttttgacccaccacatcagagtgacacaagaaccatctacgtagccaacaggtttcctcagaatggcctttacacacctcagaaatttatagataacaggatcatttcatctaagtacactgtgtggaattttgttccaaaaaatttatttgaacagttcagaagagtggcaaacttttattttcttattatatttttggttcagcttatgattgatacacctaccagtccagttaccagtggacttccattattctttgtgataacagtaactgccataaagcagggatatgaagattggttacggcataactcagataatgaagtaaatggagctcctgtttatgttgttcgaagtggtggccttgtaaaaactagatcaaaaaacattcgggtgggtgatattgttcgaatagccaaagatgaaatttttcctgcagacttggtgcttctgtcctcagatcgactggatggttcctgtcacgttacaactgctagtttggacggagaaactaacctgaagacacatgtggcagttccagaaacagcattattacaaacagttgccaatttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtccttggctgactgctagaactatacatgtgcaagggagacaaaagaactcaacagaattttactgctgcccattgcattggagacacagtttgttgaactaggtgaagttaacttcctactggaataaaaatagcactcttctgaggaacataaaagaatacagactgtctacaatgtattattatgaagtccagtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattactaaaatggaaacatcattaggtgggtctcaacaccagactgaataaatcagaccagtgaacttgaagaaaacacaaattactcagtcgaagaatggagaggaaaaaagattaggaaaaatgaacagagcttcagagccatgtgggataatattaagctgtttggcatatgtgtaattgattcccaaaaaaagagaaaaaaggacagaataaaaatatttgaaaaaataatgactgaaaatttctaaaatttgaggaagaaacttcagcctacgctaccaagatcagcaaactctaagcaggaaaaatataaagaaatataaagaaacccacaccaaagcacatcatggtcaaaatactagaatccaaagaaaaagaaaatatttcatggagccgaagagaaatgcatcacatgtaaatgaataacaatataagcgataaccagttctcatcagaaacaacggaggaca

SEQ ID NO: 2407 - DNA, 1155 bp, Artificial Sequence
  Synthetic polypeptide
atttggacactctagtagctgtaatagaatgccagcaaccagaagcagacttatacagattcatgggacgaatgatcataacccaacaaatggaagaaattgtaagacctctggggccggagagtctcctgcttcgtggagccagattaaaaaacacaaaagaaatttttggtgttgcggtatacactggaatggaaactaagatggcattaaattacaagagcaaatcacagaaacgatctgcagtagaaaagtccttggctgactgctagaactatacatgtgcaagggagacaaaagaactcaacagaattttactgctgcccattgcattggagacacagtttgttgaactaggtgaagttaacttcctactggaataaaaatagcactcttctgaggaacataaaagaatacagactgtctacaatgtattattatgaagtccagtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattactaaaatggaaacatcattaggtgggtctcaacaccagactgaataaatcagaccagtgaacttgaagaaaacacaaattactcagtcgaagaatggagaggaaaaaagattaggaaaaatgaacagagcttcagagccatgtgggataatattaagctgtttggcatatgtgtaattgattcccaaaaaaagagaaaaaaggacagaataaaaatatttgaaaaaataatgactgaaaatttctaaaatttgaggaagaaacttcagcctacgctaccaagatcagcaaactctaagcaggaaaaatataaagaaatataaagaaacccacaccaaagcacatcatggtcaaaatactagaatccaaagaaaaagaaaatatttcatggagccgaagagaaatgcatcacatgtaaatgaataacaatataagcgataaccagttctcatcagaaacaacggaggaca

SEQ ID NO: 2408 - DNA, 4039 bp, Artificial Sequence; identical to SEQ ID NO: 2238
  Synthetic polypeptide

SEQ ID NO: 2409 - DNA, 15330 bp, Artificial Sequence; identical to SEQ ID NO: 1467
  Synthetic polypeptide

SEQ ID NO: 2410 - DNA, 15330 bp, Artificial Sequence; identical to SEQ ID NO: 1468
  Synthetic polypeptide

SEQ ID NO: 2411 - DNA, 15345 bp, Artificial Sequence; identical to SEQ ID NO: 1469
  Synthetic polypeptide

SEQ ID NO: 2412 - DNA, 881 bp, Artificial Sequence
  Synthetic polypeptide
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccagggacatggatgaaactggaaaccatcattttcagcaaactatcgcaaggacaaaaaaaaccaaacaccacatgttctcactcatagtgggaattgaacaatgagaacacatggacacaggaaggggaacatcacacaccggggcctgttgtggtgtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaa

SEQ ID NO: 2413 - DNA, 803 bp, Artificial Sequence
  Synthetic polypeptide
atggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaaggccatggagaagtgtaaagatgcaggattggccaagtccatcggggtgtccaacttcaaccacaggctgctggagatgatcctcaacaagccagggctcaagtacaagcctgtctgcaaccagggacatggatgaaactggaaaccatcattttcagcaaactatcgcaaggacaaaaaaaaccaaacaccacatgttctcactcatagtgggaattgaacaatgagaacacatggacacaggaaggggaacatcacacaccggggcctgttgtggtgtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaa

SEQ ID NO: 2414 - DNA, 603 bp, Artificial Sequence; identical to SEQ ID NO: 1012
  Synthetic polypeptide

SEQ ID NO: 2415 - DNA, 534 bp, Artificial Sequence
  Synthetic polypeptide
cggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2416 - DNA, 542 bp, Artificial Sequence
  Synthetic polypeptide
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2417 - DNA, 1403 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2418 - DNA, 491 bp, Artificial Sequence
  Synthetic polypeptide
atgctcggaataacttcctgcagcgaccaacaggctaaagagggggaaggtctggagggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2419 - DNA, 578 bp, Artificial Sequence
  Synthetic polypeptide
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2420 - DNA, 1280 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2421 - DNA, 1370 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2422 - DNA, 692 bp, Artificial Sequence
  Synthetic polypeptide
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2423 - DNA, 431 bp, Artificial Sequence
  Synthetic polypeptide
tccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2424 - DNA, 344 bp, Artificial Sequence
  Synthetic polypeptide
atgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2425 - DNA, 1553 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattatagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2426 - DNA, 1493 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggaaataagcaaagagggcaatcgcctccttggaggctctggagacaattataggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2427 - DNA, 638 bp, Artificial Sequence
  Synthetic polypeptide
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgagggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2428 - DNA, 1439 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggtgtgaaaagccagggaatgaagcccgcgggagcggggaatctgggattcagggcttcagaggacagggagtttccagcaacatgaggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2429 - DNA, 1352 bp, Artificial Sequence
  Synthetic polypeptide
atgaagttccaggggcccctggcctgcctcctgctggccctctgcctgggcagtggggaggctggccccctgcagagcggagaggaaagcactgggacaaatattggggaggcccttggacatggcctgggagacgccctgagcgaaggggtgggaaaggccattggcaaagaggccggaggggcagctggctctaaagtcagtgaggcccttggccaagggaccagagaagcagttggcactggagtcaggcaggttccaggctttggcgtagcagatgctttgggcaacagggtcggggaagcagcccatgctctgggaaacactgggcacgagattggcagacaggcagaagatgtcattcgacacggagcagatgctgtccgcggctcctggcagggggtgcctggccacaatggtgcttgggaaacttctggaggccatggcatctttggctctcaaggtggccttggaggccagggccagggcaatcctggaggtctggggactccgtgggtccacggataccccggaaactcagcaggcagctttggaatgaatcctcagggagctccctggggtcaaggaggcaatggagggccaccaaactttgggaccaacactcagggagctgtggcccagcctggctatggttcagtgagagccagcaaccagaatgaagggtgcacgaatcccccaccatctggctcaggtggaggctccagcaactctgggggaggcagcggctcacagtcgggcagcagtggcagtggcagcaatggtgacaacaacaatggcagcagcagtggtggcagcagcagtggcagcagcagtggcggcagcagtggcggcagcagtggtggcagcagtggcaacagtggtggcagcagaggtgacagcggcagtgagtcctcctggggatccagcaccggctcctcctccggcaaccacggtgggagcggcggaggaaatggacataaacccgggaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2430 - DNA, 602 bp, Artificial Sequence
  Synthetic polypeptide
atgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcggggaatctgggattcaggggcaagggtcgagctggggcagtggaggaggtgacgctgttggtggagtcaatactgtgaactctgagacgtctcctgggatgtttaactttgacactttctggaagaattttaaatccaagctgggtttcatcaactgggatgccataaacaagaatatgaattaattgtcaaagtttaaacatggagagacttcacataatgatttggatttctggtttctttcaaaaactttggtaacactgggttccatttccatggggtggggttaggctagagctgagaaacagctgctgcttggcccaggtggggggtgttgggaatgggtgggggggtcactccctagtggccagactgtccctacctgtcacagtcattttagccacctgactggcccctgtgagcagtggagtttctggccttt

SEQ ID NO: 2431 - DNA, 8674 bp, Artificial Sequence
  Synthetic polypeptide
atggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2432 - DNA, 8506 bp, Artificial Sequence
  Synthetic polypeptide
atggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2433 - DNA, 3847 bp, Artificial Sequence
  Synthetic polypeptide
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2434 - DNA, 3679 bp, Artificial Sequence
  Synthetic polypeptide
atgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttatgtggagtttagacccagccagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacatgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2435 - DNA, 3452 bp, Artificial Sequence
  Synthetic polypeptide
ctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2436 - DNA, 381 bp, Artificial Sequence
  Synthetic polypeptide
agcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcagcccaatttttaaatctccacagacgtatatggatggtttactgcattatgtatctgtaataagcgacaactctggaaggctgaggcaagagggttgcttgaggccaagagttcgagaccagtcttggaaacacagtgaaaccatgtctctacgaaaactaaaataaaataaaa

SEQ ID NO: 2437 - DNA, 890 bp, Artificial Sequence; identical to SEQ ID NO: 319
  Synthetic polypeptide

SEQ ID NO: 2438 - DNA, 947 bp, Artificial Sequence; identical to SEQ ID NO: 320
  Synthetic polypeptide

SEQ ID NO: 2439 - DNA, 1398 bp, Artificial Sequence; identical to SEQ ID NO: 948
  Synthetic polypeptide

SEQ ID NO: 2440 - DNA, 1302 bp, Artificial Sequence; identical to SEQ ID NO: 949
  Synthetic polypeptide

SEQ ID NO: 2441 - DNA, 316 bp, Artificial Sequence; identical to SEQ ID NO: 1815
  Synthetic polypeptide

SEQ ID NO: 2442 - DNA, 1515 bp, Artificial Sequence; identical to SEQ ID NO: 1980
  Synthetic polypeptide

SEQ ID NO: 2443 - DNA, 143 bp, Artificial Sequence; identical to SEQ ID NO: 1010
  Synthetic polypeptide

SEQ ID NO: 2444 - DNA, 314 bp, Artificial Sequence; identical to SEQ ID NO: 1011
  Synthetic polypeptide

SEQ ID NO: 2445 - DNA, 3220 bp, Artificial Sequence; identical to SEQ ID NO: 248
  Synthetic polypeptide

SEQ ID NO: 2446 - DNA, 965 bp, Artificial Sequence; identical to SEQ ID NO: 1615
  Synthetic polypeptide

SEQ ID NO: 2447 - DNA, 2572 bp, Artificial Sequence; identical to SEQ ID NO: 1541
  Synthetic polypeptide

SEQ ID NO: 2448 - DNA, 2407 bp, Artificial Sequence; identical to SEQ ID NO: 1542
  Synthetic polypeptide

SEQ ID NO: 2449 - DNA, 651 bp, Artificial Sequence; identical to SEQ ID NO: 1543
  Synthetic polypeptide

SEQ ID NO: 2450 - DNA, 391 bp, Artificial Sequence; identical to SEQ ID NO: 1544
  Synthetic polypeptide

SEQ ID NO: 2451 - DNA, 2713 bp, Artificial Sequence; identical to SEQ ID NO: 1273
  Synthetic polypeptide

SEQ ID NO: 2452 - DNA, 228 bp, Artificial Sequence; identical to SEQ ID NO: 1274
  Synthetic polypeptide

SEQ ID NO: 2453 - DNA, 303 bp, Artificial Sequence; identical to SEQ ID NO: 148
  Synthetic polypeptide

SEQ ID NO: 2454 - DNA, 301 bp, Artificial Sequence; identical to SEQ ID NO: 147
  Synthetic polypeptide

SEQ ID NO: 2455 - DNA, 103 bp, Artificial Sequence; identical to SEQ ID NO: 173
  Synthetic polypeptide

SEQ ID NO: 2456 - DNA, 952 bp, Artificial Sequence; identical to SEQ ID NO: 1617
  Synthetic polypeptide

SEQ ID NO: 2457 - DNA, 1394 bp, Artificial Sequence; identical to SEQ ID NO: 1118
  Synthetic polypeptide

SEQ ID NO: 2458 - DNA, 1625 bp, Artificial Sequence; identical to SEQ ID NO: 1119
  Synthetic polypeptide

SEQ ID NO: 2459 - DNA, 1505 bp, Artificial Sequence; identical to SEQ ID NO: 1120
  Synthetic polypeptide

SEQ ID NO: 2460 - DNA, 1562 bp, Artificial Sequence; identical to SEQ ID NO: 1121
  Synthetic polypeptide

SEQ ID NO: 2461 - DNA, 1601 bp, Artificial Sequence; identical to SEQ ID NO: 1122
  Synthetic polypeptide

SEQ ID NO: 2462 - DNA, 1631 bp, Artificial Sequence; identical to SEQ ID NO: 1123
  Synthetic polypeptide

SEQ ID NO: 2463 - DNA, 1470 bp, Artificial Sequence; identical to SEQ ID NO: 1592
  Synthetic polypeptide

SEQ ID NO: 2464 - DNA, 202 bp, Artificial Sequence; identical to SEQ ID NO: 1593
  Synthetic polypeptide

SEQ ID NO: 2465 - DNA, 980 bp, Artificial Sequence; identical to SEQ ID NO: 139
  Synthetic polypeptide

SEQ ID NO: 2466 - DNA, 1256 bp, Artificial Sequence; identical to SEQ ID NO: 140
  Synthetic polypeptide

SEQ ID NO: 2467 - DNA, 1277 bp, Artificial Sequence; identical to SEQ ID NO: 142
  Synthetic polypeptide

SEQ ID NO: 2468 - DNA, 1052 bp, Artificial Sequence; identical to SEQ ID NO: 247
  Synthetic polypeptide

SEQ ID NO: 2469 - DNA, 327 bp, Artificial Sequence; identical to SEQ ID NO: 246
  Synthetic polypeptide

SEQ ID NO: 2470 - DNA, 639 bp, Artificial Sequence; identical to SEQ ID NO: 1176
  Synthetic polypeptide

SEQ ID NO: 2471 - DNA, 666 bp, Artificial Sequence
  Synthetic polypeptide
atgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggacttcagtgccatctccaagatacttcaaatatgtatgtgcaggtactccaaagtccaaaacacttcggtcccaagcattttgaataagggatactcaacatg

SEQ ID NO: 2472 - DNA, 649 bp, Artificial Sequence; identical to SEQ ID NO: 2075
  Synthetic polypeptide

SEQ ID NO: 2473 - DNA, 500 bp, Artificial Sequence; identical to SEQ ID NO: 204
  Synthetic polypeptide

SEQ ID NO: 2474 - DNA, 656 bp, Artificial Sequence; identical to SEQ ID NO: 205
  Synthetic polypeptide

SEQ ID NO: 2475 - DNA, 524 bp, Artificial Sequence; identical to SEQ ID NO: 207
  Synthetic polypeptide

SEQ ID NO: 2476 - DNA, 732 bp, Artificial Sequence
  Synthetic polypeptide
atgcctttgttcaccgccaaccccttcgagcaagacgtggaaaaagccacgaatgagtacaacactacagaagattggagtcttattatggacatatgtgacaaagttggaagtactcctaatggagcgaaagattgcctaaaagccataatgaaaagggtaaatcataaggttccacatgttgctctgcaagcactaactcttcttggggcttgtgtggcaaactgtggaaagatatttcatttagaagtatgttcccgtgattttgcaacagaagtacgtgctgtgattaaaaataaggcacatcctaaagtatgtgaaaaactgaaatctttaatggtggagtggtcagaagaatttcagaaggaccctcagtttagtctgatatctgcaactattaaatctatgaaagaagaaggaattacttttcctccagcaggttctcagggctgggcgcggtggctcacgcctgtaatcccagcactttgggaggccgaagtgggcagatcatgaggtcaagagatcgagaccagcctgaccaacaaggtgaaaccccatctctactaaaagtacaaaaattagctgggcgtggtggcgggcgcctgtagtcccaactactcgggaggctgaggcaggagaatcgcttgaacccaggaggcggaggttgcagtgagccaagatggcaccactgtgctccagcctggcgatggagtgagactccatctcaaaaaa

SEQ ID NO: 2477 - DNA, 721 bp, Artificial Sequence; identical to SEQ ID NO: 414
  Synthetic polypeptide

SEQ ID NO: 2478 - DNA, 4591 bp, Artificial Sequence
  Synthetic polypeptide
atgcttcaacaagttccagaaaacataaattttcctgctgaagaagagaaaatcttggagttttggactgaatttaattgttttcaggaatgcttaaagcaatcaaaacataaaccaaaatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggaatatgaaattgataagacactgggaatcagaggaccagaggatgtggccaaaatggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagccgcctgccttggcctcccaaagtgccgagattgcagcctctgcccggccgccaccccgtctgggaagtgaggagcatctctgcctggctgccaatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgctgcctcgtccaggatgtgaggagcgtctctgcccggccgccccgtctgagaagtgaggagaccctctgcctggcaaccgccccgtctgagaagtgaggagcccctccgcccggcagccgccccgtctgagaagtgaggagcccctccgcctggccagccgccccgtccgggaggtgaggggcgcctctgcccggctgcccctactgggaagtgaggagcctctctgcctggccagccgccccgtccgggagggaggtgggggggtcagccccccgcccggccagccgccctgtccgggaggtgaggggcgcctctgcccggccgcccctactgggaagtgaggagcacctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaa

SEQ ID NO: 2479 - DNA, 4261 bp, Artificial Sequence
  Synthetic polypeptide
atggggattacagagtataacaatcagtgccgagcaattgtgatgagatattctgctgagtggaagtctactgttagcagacttggccgatggattgactttgacaatgactataaaactctgtatccacaattcatggaatcagtctggtgggtcttcaaacaactctatgataaaggccttgtttatagaggtgtgaaagtcatgcccttctctacggcatgtaacactccactttccaacttcgagtcacaccagaattataaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaagatgttgccagaggacgattactcattttaatggaagccagattgtcagccctctataaattggagagtgactatgagatccttgaaagatttcctggtgcctatcttaaaggcaagaagtacaggcccctgtttgactatttcctgaagtgtaaagagaatggcgctttcactgtgcttgttgacaactatgtgaaggaagaagaaggcacaggggttgtccaccaagctccttacttcggtgctgaggactatcgggtctgtatggactttaacattattcggaaagactcactccctgtttgccctgtggatgcttcaggctgcttcacaacggaggtgacagatttcgcaggacagtatgtgaaggatgctgacaaaagtatcatcaggactttgaaggaacaaggccgacttctggttgccaccaccttcactcacagctaccctttttgctggagatcagacactcctctaatttacaaagcagtgcccagctggtttgtgcgagtggagaacatggtggaccagctcctaaggaacaatgacctgtgctactgggtcccagagttggtacgagaaaaacgatttggaaattggctgaaagatgcacgtgactggacaatttccagaaacagatactggggcacccccatcccactgtgggtcagcgatgactttgaggaggtggtatgcattgggtcagtggcggaacttgaagaactgtcaggagcaaagatctcagatctccacagagagagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggttttataccctgctggtgctggccacggccctctttggacaaccgcctttcaagaacgtaattgtgaatgggcttgtcctggcaagtgatggccaaaaaatgagcaaacggaaaaagaattatccagatccagtttccatcatccagaagtatggtgctgatgccctcagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggaggaagaaatagaatttctctacaatgagaacacggttagagaaagccccaacattacagaccggtggatcctgtccttcatgcagtctctcattggcttctttgagactgaaatggcagcttataggctttatactgtggtgcctcgcctggtcaagtttgtagatattctgaccaattggtatgttagaatgaaccgcagaagattaaagggtgaaaatgggatggaggattgtgtcatggccctagaaaccttgtttagtgttctgctttctctttgcagacttatggctccctacacaccttttctcactgaattgatgtaccagaatctaaaggtgctgattgaccctgtttctgttcaggacaaggacacactcagcattcactacctcatgctgccccgtgttcgagaagaattgattgacaagaaaacagagagtgcagtatctcagatgcagtctgtgattgaacttggaagagtgatcagagaccgaaaaactattcccataaagtatcctttgaaagaaattgtggttatccatcaagatccagaagctcttaaagatatcaagtctttggagaagtatatcattgaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactgggaccattgttgtggaaggccatgaattgcacgatgaagacatccgcctcatgtacacctttgatcaggccacaggtgggactgcgcaatttgaagcacactcagatgctcaggctttggtcctcttagatgtcactcctgaccagtcaatggtagatgaaggaatggctcgggaagtcatcaatcgcatacagaaacttcgcaaaaagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacagttgaagggatctgaactggaaattacactcaccagaggatcttcccttcctggtcctgcttgtgcatatgtcaatcttaacatttgtgcaaatggcagtgaacaaggtggagtattgctcctggaaaatccaaaaggtgacaataggttggaccttttaaagctgaagagtgttgtcactagcatttttggtgtgaaaaatacagagctggctgtcttccatgatgaaacagccgcctgccttggcctcccaaagtgccgagattgcagcctctgcccggccgccaccccgtctgggaagtgaggagcatctctgcctggctgccaatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgctgcctcgtccaggatgtgaggagcgtctctgcccggccgccccgtctgagaagtgaggagaccctctgcctggcaaccgccccgtctgagaagtgaggagcccctccgcccggcagccgccccgtctgagaagtgaggagcccctccgcctggccagccgccccgtccgggaggtgaggggcgcctctgcccggctgcccctactgggaagtgaggagcctctctgcctggccagccgccccgtccgggagggaggtgggggggtcagccccccgcccggccagccgccctgtccgggaggtgaggggcgcctctgcccggccgcccctactgggaagtgaggagcacctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaa

SEQ ID NO: 2480 - DNA, 1640 bp, Artificial Sequence
  Synthetic polypeptide
atggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatggccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaa

SEQ ID NO: 2481 - DNA, 1435 bp, Artificial Sequence
  Synthetic polypeptide
atggccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaa

SEQ ID NO: 2482 - DNA, 1628 bp, Artificial Sequence
  Synthetic polypeptide
gtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatggccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaa

SEQ ID NO: 2483 - DNA, 47 bp, Artificial Sequence; identical to SEQ ID NO: 2074
  Synthetic polypeptide

SEQ ID NO: 2484 - DNA, 572 bp, Artificial Sequence; identical to SEQ ID NO: 159
  Synthetic polypeptide

SEQ ID NO: 2485 - DNA, 3881 bp, Artificial Sequence; identical to SEQ ID NO: 1162
  Synthetic polypeptide

SEQ ID NO: 2486 - DNA, 3722 bp, Artificial Sequence; identical to SEQ ID NO: 1163
  Synthetic polypeptide

SEQ ID NO: 2487 - DNA, 1736 bp, Artificial Sequence; identical to SEQ ID NO: 156
  Synthetic polypeptide

SEQ ID NO: 2488 - DNA, 1724 bp, Artificial Sequence; identical to SEQ ID NO: 157
  Synthetic polypeptide

SEQ ID NO: 2489 - DNA, 432 bp, Artificial Sequence
  Synthetic polypeptide
atgcagtccctgatgcaggctcccctcctgatcgccctgggcttgcttctcgcggcccctgcgcaagcccacctgaaaaagcccatggccttctcccagtgcctggagcagccaagcttctttgtgcctcggggcctttgcctgagttccctcggcctgcacttacatgtctgactccgcatcctgcaagagcccggcttaagtatcacttccccaccaccctatgtaagtgagtcctttgttgctgtcagcattaccttctgctcttttcctttgtggcactcacaaatcatagtgggtgatatttatttgcattagacggtaagctcctcaaggcagggcaggagccaggtctgattgtttaccactcttgccacagcacttagcccagggcctatcatcattgctccataaatatttgtggaatgaatg

SEQ ID NO: 2490 - DNA, 609 bp, Artificial Sequence; identical to SEQ ID NO: 249
  Synthetic polypeptide

SEQ ID NO: 2491 - DNA, 738 bp, Artificial Sequence; identical to SEQ ID NO: 250
  Synthetic polypeptide

SEQ ID NO: 2492 - DNA, 537 bp, Artificial Sequence; identical to SEQ ID NO: 251
  Synthetic polypeptide

SEQ ID NO: 2493 - DNA, 684 bp, Artificial Sequence; identical to SEQ ID NO: 253
  Synthetic polypeptide

SEQ ID NO: 2494 - DNA, 285 bp, Artificial Sequence; identical to SEQ ID NO: 255
  Synthetic polypeptide

SEQ ID NO: 2495 - DNA, 552 bp, Artificial Sequence; identical to SEQ ID NO: 254
  Synthetic polypeptide

SEQ ID NO: 2496 - DNA, 750 bp, Artificial Sequence; identical to SEQ ID NO: 1060
  Synthetic polypeptide

SEQ ID NO: 2497 - DNA, 296 bp, Artificial Sequence; identical to SEQ ID NO: 1061
  Synthetic polypeptide

SEQ ID NO: 2498 - DNA, 1472 bp, Artificial Sequence
  Synthetic polypeptide
atggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatgacaaaacaagatcctgtctcaaaaagaaaaaaaaaaaaaa

SEQ ID NO: 2499 - DNA, 2151 bp, Artificial Sequence; identical to SEQ ID NO: 127
  Synthetic polypeptide

SEQ ID NO: 2500 - DNA, 1833 bp, Artificial Sequence; identical to SEQ ID NO: 126
  Synthetic polypeptide

SEQ ID NO: 2501 - DNA, 1834 bp, Artificial Sequence; identical to SEQ ID NO: 133
  Synthetic polypeptide

SEQ ID NO: 2502 - DNA, 1765 bp, Artificial Sequence; identical to SEQ ID NO: 135
  Synthetic polypeptide

SEQ ID NO: 2503 - DNA, 2154 bp, Artificial Sequence; identical to SEQ ID NO: 1502
  Synthetic polypeptide

SEQ ID NO: 2504 - DNA, 2025 bp, Artificial Sequence; identical to SEQ ID NO: 1503
  Synthetic polypeptide

SEQ ID NO: 2505 - DNA, 102 bp, Artificial Sequence; identical to SEQ ID NO: 258
  Synthetic polypeptide

SEQ ID NO: 2506 - DNA, 82 bp, Artificial Sequence; identical to SEQ ID NO: 257
  Synthetic polypeptide

SEQ ID NO: 2507 - DNA, 531 bp, Artificial Sequence
  Synthetic polypeptide
atgtattttctgagcggctggcccaagaggctgctgtgccctctggggagcccggccgaggcgcctttccacgttcagtccgacccgcagagggctttcttcgccgtgctggccgcggcccgcctcagcatctggtacagccgacctagtgtgttaattgtaacctacaaggagcctgcaaaatcatctactcagtttggatcctacaagcaagctgaatggaggccagatagtaccatgatagctgtatcaacggcaaatggatacatcttgttttttcatattacatctacaagaggggacaagtacctttatgaaccagtgtatcccaaagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacat

SEQ ID NO: 2508 - DNA, 294 bp, Artificial Sequence
  Synthetic polypeptide
atgatagctgtatcaacggcaaatggatacatcttgttttttcatattacatctacaagaggggacaagtacctttatgaaccagtgtatcccaaagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacat

SEQ ID NO: 2509 - DNA, 316 bp, Artificial Sequence
  Synthetic polypeptide
tgaatggaggccagatagtaccatgatagctgtatcaacggcaaatggatacatcttgttttttcatattacatctacaagaggggacaagtacctttatgaaccagtgtatcccaaagcttctgcgcagcaaaagaaactaccatcagagtgaagaggcaacctacagaatgggagaacatttttgcaatctactcatctgacaaagggctaatatccagcatctacaaaggactcaaacaaatttacaagaaaaaaacaaccccatcaaaaagtgggcaaaggatatgaacagacacttctcaaaagaagacat

SEQ ID NO: 2510 - DNA, 1091 bp, Artificial Sequence; identical to SEQ ID NO: 2032
  Synthetic polypeptide

SEQ ID NO: 2511 - DNA, 657 bp, Artificial Sequence
  Synthetic polypeptide
atgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2512 - DNA, 630 bp, Artificial Sequence
  Synthetic polypeptide
atggctttccagctgagcaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2513 - DNA, 693 bp, Artificial Sequence
  Synthetic polypeptide
atgctcctgcttcggagaagcttgtcactaaacgtcctcagaaaggaagtcgacagggcctgttttggggagaaggccaaacagatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2514 - DNA, 783 bp, Artificial Sequence
  Synthetic polypeptide
atgaagctgcttgccagggctctccggctctgtgagtttgggaggcaggcatcttccaggaggctggtggctggccagggatgtgtggggccccggcgagggtgctgcgctcccgtccaggtggttgggcccagggctgatctcccaccctgtggagcctgcattactggaaggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2515 - DNA, 438 bp, Artificial Sequence
  Synthetic polypeptide
atgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2516 - DNA, 753 bp, Artificial Sequence
  Synthetic polypeptide
atggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2517 - DNA, 606 bp, Artificial Sequence
  Synthetic polypeptide
atgcggccagatgatgccaacgtggccggcaatgtccacggggggaccatcctgaagatgatcgaggaggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggagggcctggcatggagtcagcactcagtagctgaatgactgga

SEQ ID NO: 2518 - DNA, 1629 bp, Artificial Sequence
  Synthetic polypeptide
atgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgaggcctccttgcctatgaaattgaattaatggcacctcctccccttcgggcttgctgcgagagaggaagggcatgagtgggtttacaagcgcctggagcag

SEQ ID NO: 2519 - DNA, 991 bp, Artificial Sequence
  Synthetic polypeptide
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagagaacctctccctctttgttatttaggttga

SEQ ID NO: 2520 - DNA, 1132 bp, Artificial Sequence
  Synthetic polypeptide
atgaaaacgccgccgggcgcttctagtcggacaaaatgcagccgagaactccgctcgttctgtgcgttctcctgtcccagggccaaacaacccacctgcactgcatggttcccccagcaagaacatcccagtgagaatggcccacagatgcctgggcgtgacccacctgcagcttcaaccatgcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagagaacctctccctctttgttatttaggttga

SEQ ID NO: 2521 - DNA, 874 bp, Artificial Sequence
  Synthetic polypeptide
atgcagccgagaactccgctcgttctgtgcgttctcctgtcccaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagagaacctctccctctttgttatttaggttga

SEQ ID NO: 2522 - DNA, 1094 bp, Artificial Sequence; identical to SEQ ID NO: 153
  Synthetic polypeptide

SEQ ID NO: 2523 - DNA, 5505 bp, Artificial Sequence; identical to SEQ ID NO: 1545
  Synthetic polypeptide

SEQ ID NO: 2524 - DNA, 5418 bp, Artificial Sequence; identical to SEQ ID NO: 1546
  Synthetic polypeptide

SEQ ID NO: 2525 - DNA, 312 bp, Artificial Sequence
  Synthetic polypeptide
atggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcatggtggcacgttcctgcagtcccagcagctactccggaggctgaggcaggaggatcgcttgagcctaggagttgagccatgatcacaccactgcactccagtctagacgacacagcgagacactgtattaaaaaaaagaaaagaaagaaaagtaaaaaa

SEQ ID NO: 2526 - DNA, 1139 bp, Artificial Sequence
  Synthetic polypeptide
atgaagaccaaatatatattttgcaatatcacagaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaataaattacctagtttctgatattctgttatagcaacacaaaacagactaagac

SEQ ID NO: 2527 - DNA, 1877 bp, Artificial Sequence
  Synthetic polypeptide
atgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaataaattacctagtttctgatattctgttatagcaacacaaaacagactaagac

SEQ ID NO: 2528 - DNA, 1895 bp, Artificial Sequence
  Synthetic polypeptide
atgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaaggggttgatttagtaagaagaaccttatcagatgccaccaccttgatattggacttccagtctccagaactattatacgataaataaagttctttttttaataaattacctagtttctgatattctgttatagcaacacaaaacagactaagac

SEQ ID NO: 2529 - DNA, 177 bp, Artificial Sequence; identical to SEQ ID NO: 1519
  Synthetic polypeptide

SEQ ID NO: 2530 - DNA, 55 bp, Artificial Sequence; identical to SEQ ID NO: 291
  Synthetic polypeptide

SEQ ID NO: 2531 - DNA, 25 bp, Artificial Sequence
  Synthetic polypeptide
atgagcgtcctttcgtttttttaaa

SEQ ID NO: 2532 - DNA, 1426 bp, Artificial Sequence; identical to SEQ ID NO: 1626
  Synthetic polypeptide

SEQ ID NO: 2533 - DNA, 533 bp, Artificial Sequence; identical to SEQ ID NO: 1098
  Synthetic polypeptide

SEQ ID NO: 2534 - DNA, 763 bp, Artificial Sequence; identical to SEQ ID NO: 261
  Synthetic polypeptide

SEQ ID NO: 2535 - DNA, 646 bp, Artificial Sequence; identical to SEQ ID NO: 262
  Synthetic polypeptide

SEQ ID NO: 2536 - DNA, 1284 bp, Artificial Sequence
  Synthetic polypeptide
atgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgccgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaagctggcgcctcgcgcgcggagaaccagacagcgccgggagaagttcctgcgctcagtaacctgcggccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtctcccagacctggtggccgacccctactacatccaggcgtccacgtacgtgcagaagatgtccatgtacaacctgagatgcgcggcggaggaaaactgtctggccagtacagcatacagggcagatgtcagagattatgatcacagggtgctgctcagatttccccaaagagtgaaaaaccaagggacatcagatttcttacccagccgaccaagatattcctgggaatggcacagttgtcatcaacattaccacagtatggatgagtttagccactatgacctgcttgatgccaacacccagaggagagtggctgaaggccacaaagcaagtttctgtcttgaagacacatcctgtgactatggctaccacaggcgatttgcatgtactgcacacacacagggattgagtcctggctgttatgatacctatggtgcagacatagactgccagtggattgatattacagatgtaaaacctggaaactatatcctaaaggtcagtgtaaaccccagctacctggttcctgaatctgactataccaacaatgttgtgcgctgtgacattcgctacacaggacatcatgcgtatgcctcaggctgcacaatttcaccgtgactctgaggcttctttcagttataagatactatg

SEQ ID NO: 2537 - DNA, 1839 bp, Artificial Sequence; identical to SEQ ID NO: 1059
  Synthetic polypeptide

SEQ ID NO: 2538 - DNA, 168 bp, Artificial Sequence
  Synthetic polypeptide
atgtcggccggcggagcgtcagtcccgccgcccccgaaccccgccgtgtccttcccgccgccccgggtcaccctgcccgccggccccgacatcctgcggacctactcgggcgccttcgtctgcctggagattcacctggcatagtgcctgaaatgtagtaggtattta

SEQ ID NO: 2539 - DNA, 722 bp, Artificial Sequence; identical to SEQ ID NO: 1598
  Synthetic polypeptide

SEQ ID NO: 2540 - DNA, 866 bp, Artificial Sequence; identical to SEQ ID NO: 1599
  Synthetic polypeptide

SEQ ID NO: 2541 - DNA, 740 bp, Artificial Sequence; identical to SEQ ID NO: 1600
  Synthetic polypeptide

SEQ ID NO: 2542 - DNA, 884 bp, Artificial Sequence
  Synthetic polypeptide
atgtccccagaagtggccttgaaccgaatatctccaatgctctcccctttcatatctagcgtggtccggaatggaaaagtgggactggatgctacaaactgtttgaggataactgacttaaaatctggctgcacatcattgactcctgggcccaactgtgaccgatttaaactgcacataccatatgctggagagacattaaagtgggatatcattttcaatgcccaatacccagaactgcctcccgattttatctttggagaagatgctgaattcctgccagacccctcagctttgcagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactggactggtgaattttcagctcgtttccttttgaagctgcccgtagatttcagcaatatccccacataccttctcaaggatgtaaatgaagaccctggagaagatgtggccctcctctctgttagttttgaggacactgaagccacccaggtgtaccccaagctgtacttgtcacctcgaattgagcactgggcgcaatggctcacgtctataatcccagcactctaggagtccgaggcagggggatcactagctgggaggctgaggcaggagaatcgcttgaacggagaggtggaggttgcagtaagccaagaacgcaccattgcactccagcctgggcgacaagagtgaaactccgtctcaaaaaaaaaaaaaaaaaaaaaaaagaaaaa

SEQ ID NO: 2543 - DNA, 623 bp, Artificial Sequence
  Synthetic polypeptide
atgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactgggtactccaaagtccaaaacacttcggtcccaagcattttgaataagggatactcaacatg

SEQ ID NO: 2544 - DNA, 2361 bp, Artificial Sequence; identical to SEQ ID NO: 1330
  Synthetic polypeptide

SEQ ID NO: 2545 - DNA, 2160 bp, Artificial Sequence; identical to SEQ ID NO: 1331
  Synthetic polypeptide

SEQ ID NO: 2546 - DNA, 1908 bp, Artificial Sequence; identical to SEQ ID NO: 1332
  Synthetic polypeptide

SEQ ID NO: 2547 - DNA, 2175 bp, Artificial Sequence; identical to SEQ ID NO: 1333
  Synthetic polypeptide

SEQ ID NO: 2548 - DNA, 1606 bp, Artificial Sequence; identical to SEQ ID NO: 327
  Synthetic polypeptide

SEQ ID NO: 2549 - DNA, 175 bp, Artificial Sequence; identical to SEQ ID NO: 329
  Synthetic polypeptide

SEQ ID NO: 2550 - DNA, 1068 bp, Artificial Sequence; identical to SEQ ID NO: 1221
  Synthetic polypeptide

SEQ ID NO: 2551 - DNA, 571 bp, Artificial Sequence
  Synthetic polypeptide
atggcagcgctgcgctacgcggggctggacgacacggacagtgaggacgagctgcctccgggctgggaggagagaaccaccaaggacggctgggtttactacgccaatcacaccgaggagaagactcagtgggaacatccaaaaactggaaaaagaaaacgagtggcaggagatttgccatacggatgggaacaagaaactgatgagaacggacaagtgttttttgttgaggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctaca

SEQ ID NO: 2552 - DNA, 1248 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 2553 - DNA, 951 bp, Artificial Sequence
  Synthetic polypeptide
atggaatgtctctactatttcctgggatttctgctcctggctgcaagattgccacttgatgccgccaaacaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 2554 - DNA, 1074 bp, Artificial Sequence
  Synthetic polypeptide
atggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtgggaactgaacaatgagaacacttggacacagggcggggaacatcacacaccagggcctgtcggggggtaggggtagggaggcgggatggcattaacagaaatacctattgtaaatgacgagttaatgggtgcagcacaccaacatggcacatgtatacatatgtaacaaacctgcactttgtgcacatgtaccctagaacttaaagtaaaatttaaaaaaaagagaa

SEQ ID NO: 2555 - DNA, 6132 bp, Artificial Sequence; identical to SEQ ID NO: 1117
  Synthetic polypeptide

SEQ ID NO: 2556 - DNA, 677 bp, Artificial Sequence; identical to SEQ ID NO: 2175
  Synthetic polypeptide

SEQ ID NO: 2557 - DNA, 77 bp, Artificial Sequence; identical to SEQ ID NO: 1778
  Synthetic polypeptide

SEQ ID NO: 2558 - DNA, 299 bp, Artificial Sequence; identical to SEQ ID NO: 1033
  Synthetic polypeptide

SEQ ID NO: 2559 - DNA, 191 bp, Artificial Sequence; identical to SEQ ID NO: 1034
  Synthetic polypeptide

SEQ ID NO: 2560 - DNA, 1081 bp, Artificial Sequence
  Synthetic polypeptide
atggcatttacagaaagagtcaacagcagtggcaacagcagcctgccttggcctcccaaagtgccgagattgcagcctctgcccggccgccaccccgtctgggaagtgaggagcgtctctgccaggccgcccatcgtctgggatgtgaggagcccttctgcctggctgcccagtctggaaagtgaggagcgtctctgcctggccgccatcccatctgggaagtgaggagcgtctctgcccggccgcccatcgtctgagatgtggggagcacctctgccctgccgccccgtccgggatgtgaggagcgtctctgcccggccgccccgtctgagaagtgaggagcccctccgcccggcagccgccccgtctgagaagtgaggagcccctccgcccagcagccaccccgtctgggaagtgaggagcgtctctgcccggcagccacctcgtctgggagggaggtgggggggtcaggcccccgcccggccagccgccctgtccgggaggtgaggggcacctctgcccggccgcccctactgggaagtgaggagcccctctgcctggccaccaccccgtctgggaggtgtacccaacagctcattgagaacgggccatgatgacaatggcggttttgtggaatagaaaggggggaaaggtggggaaaagattgagaaatcggatggttgctgtgtctgtgtagaaagaggtagacatgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaat

SEQ ID NO: 2561 - DNA, 5107 bp, Artificial Sequence
  Synthetic polypeptide
atgagggcactggtcagggcccattccatagcagggttttcaccagagtgccccgaggatcccgtgggacagaatgttgtgaagtctgggacccatgtgaaggaaggggccaaaaatgaacgagatccaagaatacaaaacatcccttcccctgcacccacccagctgtctggcccgattcctgcttttcagagtggggctccccatctgcagggtccctgcaagcctggtgggtttcgcttgcaaagggcctctcaggacactccttctgcaggtctcctgggggaaaaccagttaagacaggattccaggtcatgtctggtggcttcatgcctcacctcagagttagtgaagctcagtgcagaggaagtgcctgagcccgctgagtgcaagtcagagcaaagcccagaaagcagaacccaggaaccccaaggcacccaactcgcaccaagagctgctgatgagagagagacacagaagcacctctggggcatttctgtccaggcaggaaaccaaaccagtaattacacatcaaagtatgtgctcagcgaggaaagcaagtcacctaccagggccaagttcccacggcagcctagcagtgaggggacccaggtgtggagtggagacttgatgggctgcttggaagtgagtgacagttcagatgcccctgagaccacccagaaatcaagcgcaatagacacttcaaaggcagccgaagaagccatggttctagaccccaactacagggaacaggctttgcaaggtctttcagaattcaaggcagccacggtgtctcactgcggccccggggctgaggagggtgaacaggggcctgggggtgccgggggccggcagctggagcccaaagcaggcggcgaggcctcgaggggcaggggcgccctcatcattgtagctgtggagcagaaaggtcttcaggccagcaggagcaatgcggggcctgttccagaaacactgccccgtgactttcctaaggaaagaccagaatctcccttgagcactggcgagaccccctgtgagtctcccactagggggaaaacaccagccggtaatgagtgtgagttgccagcagcccccatacagggagctggcgatggggctcttcagcgggtggcccaggccgcagagcttgggagagtgctggtcccccaagctgcttcggaagagacgccgagcacagaggagcccccgggagagagactgcgtggggagagccggagctccgggtcaggggagcgtggcccggaggaggcccccgaaggcggtgctgcagcagcccggggccagcgcccccgcgtccccgccttggagccgccccagccgccacgcgggctccgcaagggcgcgcaggagcctgggaagcgcccgacgttttccaaggtgacctccttcaggaagggcaggcccttggccactgagagcccaggaggggtcccggccccgaccaccgagggtcgccgctggggctcttcaggccccgaggggctccccagggagaatccgcccgctgcggccggtcgggacgcaccgcctctgcaccacggggacgccagcgcctggcccgagtttgtcccgcaggctgcaggcgacaggactgcagggccggcaggagcggggcacacggggacctcaggggatcttggtagccgagggccttcctctgagagctgcaacgcaaagagactcaaaacaacggagaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataa

SEQ ID NO: 2562 - DNA, 2539 bp, Artificial Sequence
  Synthetic polypeptide
atgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataa

SEQ ID NO: 2563 - DNA, 3079 bp, Artificial Sequence
  Synthetic polypeptide
ccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccaatatcatactgaatgggcaaaaactggaagcattccctttgacaactggcacaagatagggatgccctatctcgccactcctattcaacatagtgttggaagttctggccagggcaatcaggcaagagaaagcaataaaggatattcagttaagaaaagagaaagtcaaattgtccctgtttgcaaatgacatgattgtatatttagaaaaccccatcgtttcagcccaaaatctccttaagctgataagcaacttcagcaaagtctcagggtacaaaatcaatgtgcaaaaatcacaagcattcctatacactaataacagacagccaaatcatgagtgaactcccattcacaattgttacaaagagaataaaatacctaggaatccaacttacaagggatgtgaaggacctcttcaaggagaactacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaattactttaaagttcatatggaatcaaaaaaaaagcccgcattgccaagacaatcctaagcaaaaagaacaaaactggaggcatcatgctacctgacttcaaagtatactacaagtctacagtaaccaaaacagcatggtactggtaccaaaacagagatatagaccaatggaacagaacagaggcctcagaaataacaccacacatctacaaccatctgatctttgacaaacctgacaaaaacaagaaatggggaaaggattccctatttaataaatggtgttgggaaaactggctagccatatgtagaaagctgaaactggatcctttccttgcaccttatacaataattaattcaaggtggattaaaacttaaatgttagacctaaaatcgtaaaagccctagaagaaaacctaagcaataccattcaggacataggcatgggcgaggacttcatgactaaaacaccaaaagtaatggcaacaaaagccaaaatagacaaatgggatctaattaaactaaagagcttctgcacagcaaaagaaactaccattagagtgaacagacaacctacagaatgggagaaaatttttgcaatctacccatctgacaaagggctaacatccagaatctgcaaagaacttaaacaaatttacaagaaaaaaacaaccctgtcaaaaagtgggcaaaggatatgaacagacacttctcaaaagaagacatttatgcagccaacagacacatgaaaaaatgttcatcatcactggtcatcagagaaatgcaaatcaaaaccacaatgagataccatctcacaccagttagaatggcaatcattaaaaagtcaggaaacaacaggtgttggagagaatgtggagaaataggaatgctcttacactgttggtgggagtgtaaactagttcaaccattgtggaagacagtgtgacgattcctcaaggatctagaactagaaataccatttgacccagccatcccattactgggtatgtacccaaaggattataaatcatgctgctataaagacacgtgcacatgtatgtttattgcagcactgttcacaatagcaaagacttggaaccgacccaaatgtctgtcagtaatagactggattaagaaaatgtggcatatatacaccgtggaatactatggagccataaaaaaggatgagttcctgtcctttgcagggtcatggatgaagctggaaaccatcattctgagcaaactatcacaagaacagaaaaccaaacactgcatgttctcactcataggtgggaagtgaacaatgagaacacttggacacagggcggggaacatcacacagggaggcttgccatggggtggcagggggagggatagcattaggagaaatacctaatgtaaatgatgagttaatgggtgcagcacaccaatgtggcacatgtatacatatgtaacaaacctgcacgttgtgcacatgtaccttagaacttaaagtataattaaaaaaataa

SEQ ID NO: 2564 - DNA, 4277 bp, Artificial Sequence; identical to SEQ ID NO: 2069
  Synthetic polypeptide

SEQ ID NO: 2565 - DNA, 1156 bp, Artificial Sequence; identical to SEQ ID NO: 1222
  Synthetic polypeptide

SEQ ID NO: 2566 - DNA, 919 bp, Artificial Sequence; identical to SEQ ID NO: 1223
  Synthetic polypeptide

SEQ ID NO: 2567 - DNA, 941 bp, Artificial Sequence; identical to SEQ ID NO: 1224
  Synthetic polypeptide

SEQ ID NO: 2568 - DNA, 577 bp, Artificial Sequence; identical to SEQ ID NO: 1112
  Synthetic polypeptide

SEQ ID NO: 2569 - DNA, 252 bp, Artificial Sequence; identical to SEQ ID NO: 1113
  Synthetic polypeptide

SEQ ID NO: 2570 - DNA, 1692 bp, Artificial Sequence; identical to SEQ ID NO: 1048
  Synthetic polypeptide

SEQ ID NO: 2571 - DNA, 1695 bp, Artificial Sequence; identical to SEQ ID NO: 1049
  Synthetic polypeptide

SEQ ID NO: 2572 - DNA, 466 bp, Artificial Sequence; identical to SEQ ID NO: 1050
  Synthetic polypeptide

SEQ ID NO: 2573 - DNA, 2474 bp, Artificial Sequence; identical to SEQ ID NO: 1065
  Synthetic polypeptide

SEQ ID NO: 2574 - DNA, 1694 bp, Artificial Sequence; identical to SEQ ID NO: 1066
  Synthetic polypeptide

SEQ ID NO: 2575 - DNA, 1361 bp, Artificial Sequence; identical to SEQ ID NO: 1067
  Synthetic polypeptide

SEQ ID NO: 2576 - DNA, 688 bp, Artificial Sequence; identical to SEQ ID NO: 1068
  Synthetic polypeptide

SEQ ID NO: 2577 - DNA, 531 bp, Artificial Sequence; identical to SEQ ID NO: 1069
  Synthetic polypeptide

SEQ ID NO: 2578 - DNA, 266 bp, Artificial Sequence
  Synthetic polypeptide
atgaacccggtacctcagatggaaatgcagaaatcacccgtcttctgtgtcgctcacgctgggagctgtagaccggagctgttcctattcggacatcttggctcctccccaagagttctggagtctgagaagtcaaggatcggggtgctggcctattcagttcctggtaagggctgtcttcctggcttgcagttgaactacttcttgctgtgtcttcacaagtctcaggtatgtctttatcagcagcatgaaaatggactaataca

SEQ ID NO: 2579 - DNA, 897 bp, Artificial Sequence
  Synthetic polypeptide
atggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggcacggtggctcacgcctgtaatctcagcactttgggaggccgaggcgggcagctcacgaggtcaggagatcgagaccatcctggctaacacggtgaaatcccatctctactaaaaatacaaaaaattagccgggcatggtggcccgtgtctgcagtcccagctactcgggaggctgaggcaggagaatggcgtgaacccaagaggcggagcttgcagtgagctgagatcgcaccactacactccagactgggcgacagagcgagactccatctcaaa

SEQ ID NO: 2580 - DNA, 468 bp, Artificial Sequence
  Synthetic polypeptide
atgggtgcctacctctcccagcccaacacggtgaagtgctccggggacggggtcggcgccccgcgcctgccgctgccctacggcttctccgccatgcaaggctggcgcgtctccatggaggatgctcacaactgtattcctgagctggacagtgagacagccatgttttctgtctacgatggacatggaggctgggcacgcggtaggtcacacctgtaatcccggcacagtggatcacgaggtcaggagttcgagaccagcctgaccaatatggtgaaaccccatctctactaaaaatacaaaaattagctgggcgtagtggtgggcgcctgtggtcccagctgctcggaaggctgaggcaggagaatcgcttgaacctgggaggtggaggttgcagtgagccaagaccatgccactgcactccagcctgggcaacagagcaagactcttgtcttaaaaaacaaaaaa

SEQ ID NO: 2581 - DNA, 3995 bp, Artificial Sequence; identical to SEQ ID NO: 2035
  Synthetic polypeptide

SEQ ID NO: 2582 - DNA, 3836 bp, Artificial Sequence; identical to SEQ ID NO: 2036
  Synthetic polypeptide

SEQ ID NO: 2583 - DNA, 506 bp, Artificial Sequence; identical to SEQ ID NO: 1096
  Synthetic polypeptide

SEQ ID NO: 2584 - DNA, 150 bp, Artificial Sequence; identical to SEQ ID NO: 384
  Synthetic polypeptide

SEQ ID NO: 2585 - DNA, 390 bp, Artificial Sequence; identical to SEQ ID NO: 380
  Synthetic polypeptide

SEQ ID NO: 2586 - DNA, 299 bp, Artificial Sequence; identical to SEQ ID NO: 383
  Synthetic polypeptide

SEQ ID NO: 2587 - DNA, 718 bp, Artificial Sequence; identical to SEQ ID NO: 1366
  Synthetic polypeptide

SEQ ID NO: 2588 - DNA, 755 bp, Artificial Sequence; identical to SEQ ID NO: 2148
  Synthetic polypeptide

SEQ ID NO: 2589 - DNA, 290 bp, Artificial Sequence; identical to SEQ ID NO: 2149
  Synthetic polypeptide

SEQ ID NO: 2590 - DNA, 800 bp, Artificial Sequence; identical to SEQ ID NO: 2150
  Synthetic polypeptide

SEQ ID NO: 2591 - DNA, 281 bp, Artificial Sequence; identical to SEQ ID NO: 2151
  Synthetic polypeptide

SEQ ID NO: 2592 - DNA, 620 bp, Artificial Sequence
  Synthetic polypeptide
atgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2593 - DNA, 1292 bp, Artificial Sequence
  Synthetic polypeptide
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2594 - DNA, 1400 bp, Artificial Sequence
  Synthetic polypeptide
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2595 - DNA, 1310 bp, Artificial Sequence
  Synthetic polypeptide
atgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2596 - DNA, 497 bp, Artificial Sequence
  Synthetic polypeptide
gcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2597 - DNA, 412 bp, Artificial Sequence
  Synthetic polypeptide
aaaaagcgcatgctgaagaaagggaattatggaagacagaacatgcaaaagatcaagaaaaagtatctcaggaaattcaaaaagctatacaagaacaaagaaaaataagtcaggaatctcctggaggaggtactctaccacagcaaagggtaaaccaagaagaaataatccactgggatctagaaagctgggagattcaattcaaggaatatatagggaaccctcaagaataggactgagggagatctcagaatggacatttatttaacagacccagagaacaaccagtccagtttggagataggtcaaggaagttgtatctccaagaagacaaacagaatgtttcatatctttaagcatattgagaagatatatacaactaggagagaatttgggcattaactcataataa

SEQ ID NO: 2598 - DNA, 1928 bp, Artificial Sequence
  Synthetic polypeptide
atgcaatcccggcttctactcctcggggcacccggaggccacggcggcccggcctcgcggcgcatgcggctgctcctgcggcaggtggtgcagcgcaggccgggtggcgacaggcagcggccggaggtcagactgttgcacgccggctcgggggccgacacaggtgatacagttaatattggagatgtatcctacaagttgaaaattcctaagaatccagaacttgtgccacagaactacatttcagactctctggctcaatctgtagttcagcatctaagatggataatgcagaaggatcttttggggcaagatgtttttctaataggacctcctgggcctcttcgacgctctattgctatgcagtacttggagctgaccaaacgggaggtcgaatacattgccctgtcaagggacaccactgaaactgatctcaaacagcgacgagagatccgtgcaggcacagccttttacattgatcagtgtgcagttcgtgcagccacagaaggcagaactctcattttggaaggtttggaaaaggcagagaggaatgttttgcctgttttgaacaacttgctggaaaacagagagatgcagcttgaagatggacgcttcctgatgtctgctgagcgttacgacaaacttctccgagatcataccaaaaaagagttggattcttggaaaattgtccgagttagtgaaaatttccgagtgattgccttgggcttgccagtgccaaggtattctgggaatccattagacccccctcttcgttctcgatttcaagccagggatatttattatttacccttcaaggaccaacttaagttgttatattcaattggagccaatgtttctgctgagaaagtttctcagctcttgtcctttgccacaactctgtgttcccaagaatcttctactcttggacttccagactttcctttagatagtttagcagctgcggttcaaatcttggattcctttcctatgatgccaatcaaacatgcaatccagtggctttatccatatagtattttactaggtcatgaagggaagatggctgtggaaggtgttttaaaggaagtgaggagcgtctctgcccggccgcccatcgtctgagatgtggggagagcctctgccctgccgccccgtctgggatgtgaggagcacctccacccggccgcgaccccgtctgggaggtgaggagcgtctctgcccggccgccccgtctgagaagtgaggagaccctccgcctggcaaccgcccgtctgagaagtgaggagcccctccgcccggaagccgccccatctgagaagtgaggagcccctccgtcccggcagtcaccctgtctgggaagtgaggagcgtctccgcccagcagccaccccgtccgggagggaggtgggggtcagcccccgccaggccagccgccccgtccgggagggaggtgggggggtcagccccccgcccggccagccgccccgtccgggaggtgaggggcacctctgcccggccgcccctactgggaagtgaggagctcctctgcccagccagtcgccccgtccaggagggaggtgggggggtcagcccccagcccggccagccgccccgtccgggaggtgaggggcgcctctgcccggccgcccctactgggaagtgaggagccctctgcccagccgcccctactgggaagtgaggagcccctctgcctggccaccaccccgtctgggaggtgtacccaacagctcattgagaacgggccatgatgacaatggcggttttgtggaacagaaggggggaaaggtggggaaaagattgagaaatcggatggttgccgtgtctgtgtagaaagaggtagacatgggagacttttcattttgttctgtactaagaaaaattcttatcctgttgatctgtgaccttaccccc

SEQ ID NO: 2599 - DNA, 728 bp, Artificial Sequence
  Synthetic polypeptide
atgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaacactgcattttggtgtttcct

SEQ ID NO: 2600 - DNA, 428 bp, Artificial Sequence
  Synthetic polypeptide
atgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggcctgctatttaccctgggttatccttggattcaactatatcatcggaggctcggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaacactgcattttggtgtttcct

SEQ ID NO: 2601 - DNA, 428 bp, Artificial Sequence
  Synthetic polypeptide
atgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggctggaatgtagaagtggacttttggccacgtggatgaggaattgaagcagtcagttctgatctagagatggaaggcgcctgctgaggacagcagggctgcttggcaccctgggtccctgaatggctctgtggagcactgcctgatggcccaccctggactgttgcctgagacagaaataaacttttatcttgtttcaaacactgcattttggtgtttcct

SEQ ID NO: 2602 - DNA, 193 bp, Artificial Sequence
  Synthetic polypeptide
atggcaggtctctgagtctcaggccccttcccaccttgtgatggtttttgagcctttgccccagtgtctggctgttcgttgggtacacagtaatctcatctgacaagtttgtgaatttgggaagaaataattcacaggagatgctcatcacggggttttgcacacagtaagtgctgcataagtggagctatta

SEQ ID NO: 2603 - DNA, 1822 bp, Artificial Sequence
  Synthetic polypeptide
atggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcagcagggcgtggtggcgcaggctttgtagtcccagatactctggaggctgaggcccaggaggacgaggctgcagggagccatgatcacgccactgcactccaccctgggcgacagagcgagaccttgtctcagaaaaaa

SEQ ID NO: 2604 - DNA, 1368 bp, Artificial Sequence
  Synthetic polypeptide
cccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcagcagggcgtggtggcgcaggctttgtagtcccagatactctggaggctgaggcccaggaggacgaggctgcagggagccatgatcacgccactgcactccaccctgggcgacagagcgagaccttgtctcagaaaaaa

SEQ ID NO: 2605 - DNA, 1655 bp, Artificial Sequence
  Synthetic polypeptide
atgggggacgctcccagccctgaagagaaactgcaccttatcacccggaacctgcaggaggttctgggggaagagaagctgaaggagatactgaaggagcgggaacttaaaatttactggggaacggcaaccacgggcaaaccacatgtggcttactttgtgcccatgtcaaagattgcagacttcttaaaggcagggtgtgaggtaacaattctgtttgcggacctccacgcatacctggataacatgaaagccccatgggaacttctagaactccgagtcagttactatgagaatgtgatcaaagcaatgctggagagcattggtgtgcccttggagaagctcaagttcatcaaaggcactgattaccagctcagcaaagagtacacactagatgtgtacagactctcctccgtggtcacacagcacgattccaagaaggctggagctgaggtggtaaagcaggtggagcaccctttgctgagtggcctcttataccccggactgcagccgcctgccttggcctcccaaagtgccgagattgcagcctctgcctggctgccaccccatctgggaagtgaggagcgtctctgcctggccgcccatcgtctgggatgtgaggagcccctctgcccggccgcccagtcttggaagtgaggagcgcatcttcccggccgccatcacgtctgggaagtgaggagcgtctctgcccggctgcccatcgtctcagatgtggggagcacctctgccccgccgccccgtctgggatgtgaggagcgcctctgtccggccgcgacccggtctgggaactgaggagtgtctctgcccgaccgccaccccgtctgggaggtgaggagcgtctttgcccagccgccccgtctgagaagtgaggagcccctccgcctggcagccgccccgtctgggaagtgaggagcgtctccgcccggcagccgccccgtccgggaggtggggggcagccgccgcccggccagccgccctgtccaggagggaggtggggggcaacccccgcccggccagccaccccgtccgggagggaggttgggggtgcctctgaccggccgccccgtctgggaagtgaggagcccctctgcccggcggccaccccgtctgggaggagtacccaacagctcgttgagaacgggccatgatgacgatggcggttttgtcgaatagaaaagggggaaatgtggggaaaagaaagagagatcagattgttactgtgtctgtgtggaaagaggtagacatgggagactccattttgttctgtactaagaaaaattcttctgccttgggatgctgttaatctataaccttacccccaaccccgtgctctctgaaacatgtgctgtgtccactcagggttaaatggataaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactattaaaaaaaaaaa

SEQ ID NO: 2606 - DNA, 3723 bp, Artificial Sequence; identical to SEQ ID NO: 1743
  Synthetic polypeptide

SEQ ID NO: 2607 - DNA, 3708 bp, Artificial Sequence; identical to SEQ ID NO: 1744
  Synthetic polypeptide

SEQ ID NO: 2608 - DNA, 3333 bp, Artificial Sequence; identical to SEQ ID NO: 1745
  Synthetic polypeptide

SEQ ID NO: 2609 - DNA, 610 bp, Artificial Sequence
  Synthetic polypeptide
atgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggcacccagcacatagaaagtctttggtgaatgaatga

SEQ ID NO: 2610 - DNA, 734 bp, Artificial Sequence; identical to SEQ ID NO: 930
  Synthetic polypeptide

SEQ ID NO: 2611 - DNA, 364 bp, Artificial Sequence
  Synthetic polypeptide
atgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgccatactgtaagctccaggacagcaaagaccatgcctgttttatacccgctacatccccagtgcctgaaaaagaacagatgctcaggacatatttattgactgaatgaat

SEQ ID NO: 2612 - DNA, 373 bp, Artificial Sequence
  Synthetic polypeptide
atgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgccatactgtaagctccaggacagcaaagaccatgcctgttttatacccgctacatccccagtgcctgaaaaagaacagatgctcaggacatatttattgactgaatgaat

SEQ ID NO: 2613 - DNA, 339 bp, Artificial Sequence
  Synthetic polypeptide
atgggcaatggcatgaccaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgccatactgtaagctccaggacagcaaagaccatgcctgttttatacccgctacatccccagtgcctgaaaaagaacagatgctcaggacatatttattgactgaatgaat

SEQ ID NO: 2614 - DNA, 1091 bp, Artificial Sequence
  Synthetic polypeptide
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2615 - DNA, 1118 bp, Artificial Sequence
  Synthetic polypeptide
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2616 - DNA, 1325 bp, Artificial Sequence
  Synthetic polypeptide
atggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2617 - DNA, 1229 bp, Artificial Sequence
  Synthetic polypeptide
atggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggttgttgtgattactcaggaaagcaagactagtcaagcactttgcacagggcctggcacatagtagatgctcaacaaatactgctgtgtt

SEQ ID NO: 2618 - DNA, 2761 bp, Artificial Sequence
  Synthetic polypeptide
atgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2619 - DNA, 2248 bp, Artificial Sequence
  Synthetic polypeptide
atgggctgtctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2620 - DNA, 2656 bp, Artificial Sequence
  Synthetic polypeptide
atgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacagctctgaagaggcaaagacactcacaatggacatattgacattggctcacacctccacagaagctaagggcctgtcctcagagagcagcgcctcttccgacagcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcccccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctgatgccacggttgggaccccactccccactaacagcgccacagaaagagaagtgacagcacccggggccacgaccctcagtggagctctggtcacagttagcaggaatccccttgaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2621 - DNA, 995 bp, Artificial Sequence
  Synthetic polypeptide
accgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtgaaaatggaggtttcctcctcctgcggctgagtgtggcttccccggaagacctcactgaccccagagtggcagaaaggctgatgcagcaggaaattctgctggctctaaggccatcaaactgtgcccagaatgtggcccctcctcagcatctccagtgctaccaccgagatggtccacgatgccatcatctctcacctgcactactacaggtctccctgtttccagctcagcccccaccccagtctagtcccagtgtgtcagccagggctgtctttttacaacataaggcagaccacaccacttctttgctccaatcctcccatttcactcagaagaaaagctccgacaacagctgcaaagccgtgcacgacctgcgcccctcccctgcctccttaatttgctgactgcaccgcagccacacggacgtctttcttgtcccttgaatgcgctgggcctgctcttgccttgggacctttctgtgcattgcttagtctgctcagaagccttctcctctacatatccacttgtctaaaccctctacctccaccttcatgccccttctcagcgaggtctaccatgaccatgctgcctacaaattcagtctccccttctgtactttgacgtactttatagtgctgatcacaattgaacgtcatacatattttgttttctttattatctgagtcctccaactagaatgaaagattttgcccattatggtttccctagtgccaagaacagtacctggcacataccaggggctcagtaaacatttgttagatgaatgaa

SEQ ID NO: 2622 - DNA, 307 bp, Artificial Sequence
  Synthetic polypeptide
atgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggtgtgatggcgggcatctgtaatcccaactgctggagaggctgaggcaggagaatcgcttgaatccaggaggcggaggttgcagtgagttgagatcacgccattgcattccagcctgggcgacacagcgagactccatctcaaaaaagaaaaagaaaaagaaaaa

SEQ ID NO: 2623 - DNA, 123 bp, Artificial Sequence
  Synthetic polypeptide
atgaaaagaaatacctgtgatttgctttctcggagcaaaagtgacttgagcatctgaagattttggtttctgcagagggtgggaaaggttgaaccaatcccccatggataccaaggtaaaact

SEQ ID NO: 2624 - DNA, 130 bp, Artificial Sequence
  Synthetic polypeptide
atgagaacttcctaccttctgctgtttactctctgcttacttttgtctgagatggcctcagaatgaggggctgggaaggatgatcctgaaagcaagcactccagttcagaaagtctctgtaagatcctat

SEQ ID NO: 2625 - DNA, 2647 bp, Artificial Sequence
  Synthetic polypeptide
atggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagaaatggaaaagctaatcctaaaatacatatgaaattcaagggacacaaaatagccagaacagtattgaaaaagaacaaagttgcaagactcacacttcccagttctaagacttgctacaaagctataataatcaaagcagtatagtgtggcacaaagatagacgtggagatcaaaggaatcacatttagagtctagaaacaaaccctcacatttatagtccattgatttttgacaagagtgacaagacaattcaataaggaaagaatagtcttttcagcaatggtgccgggacacagatatccacatgaaaaagagtgaatttggacctcaaccttatactatacagaaaaaaaattcaaagggcatcaaagacctaaatataagagatgaaactataaaattcttagaaaacacaggggtaaatcttcatggccttggattttgcaatggtttcttagatatgacttcaaaaccacaaataaccaaagaaaaaaatagctactttgtattttaccaaaaagaaaaactttgatgcttcaaaggacattatcaagcaagtgaaaaacaacccacagaatgggagaaaatatttgtacatcatatgtcagaaaaatgtcttagtatccagaatatgtaaagaactcttaaaactcaaaaataagaagacaaataaccctttttttgatggtcaaaagagttgaatagacttttttttcaaagaagatataaaacggtcaataagcaaatgaaaagatgctcaacatctttagtcattagagaaatgcaaattaaaaccacagtggccacttcacactcctactaggatgactagaatcaaaaaaagcagacaataacatgagttggccaggatgtggagaaattgaaaccccggttcattgctggtgggagtgtaaaatggtacagctgctttggaaaatagtttggcagttccgtagaaagttaaacatagagttaccatatggcccaaggatgagtaattctactcctaggtgtatacctcagagaattgaaaacatatgttcatatgaaaattgtacatgaatatccacagcagcatcattcataatagccaaagaatggaaacaaccccaatgtccatcagcttgaaaatgaataaacaaaatg

SEQ ID NO: 2626 - DNA, 440 bp, Artificial Sequence
  Synthetic polypeptide
atgaccgaaggggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgcccccagactcatcctcaaagctattatcaccacctggaattgattatctgatcaacgtctgtcccccccccccagccatactgtaagctccaggacagcaaagaccatgcctgttttatacccgctacatccccagtgcctgaaaaagaacagatgctcaggacatatttattgactgaatgaat

SEQ ID NO: 2627 - DNA, 449 bp, Artificial Sequence
  Synthetic polypeptide
atgggcaatggcatgaccaaggtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgcccccagactcatcctcaaagctattatcaccacctggaattgattatctgatcaacgtctgtcccccccccccagccatactgtaagctccaggacagcaaagaccatgcctgttttatacccgctacatccccagtgcctgaaaaagaacagatgctcaggacatatttattgactgaatgaat

SEQ ID NO: 2628 - DNA, 415 bp, Artificial Sequence
  Synthetic polypeptide
atgggcaatggcatgaccaagatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgcccccagactcatcctcaaagctattatcaccacctggaattgattatctgatcaacgtctgtcccccccccccagccatactgtaagctccaggacagcaaagaccatgcctgttttatacccgctacatccccagtgcctgaaaaagaacagatgctcaggacatatttattgactgaatgaat

SEQ ID NO: 2629 - DNA, 171 bp, Artificial Sequence
  Synthetic polypeptide
atgctaggagcgatgcaggtttccaaatatggtgacctggctaactggatgatacctgcaacaagcttttccaggagaaggaccttgttttgatctgactctagcaccctagtatacagcaacacttatactagacattcagtaagttgaattgattgaagataagtgaat

SEQ ID NO: 2630 - DNA, 1362 bp, Artificial Sequence
  Synthetic polypeptide
atggcggctctcaaactcctctcctccgggcttcggctctgcgcctctgcccgcggatctggggcaacctggtacaagggatgtgtttgttccttttccaccagtgctcatcgccataccaagttttatacagatccagtagaagctgtaaaagacatccctgatggtgccacggttttggttggtggttttgggctatgtggaattccagagaatcttatagatgctttactgaaaactggagtaaaaggactaactgcagtcagcaacaatgcaggggttgacaattttggtttggggcttttgcttcggtccaagcagataaaacgcatggtctcttcatatgtgggagaaaatgcagaatttgaacgacagtacttatctggtgaattagaagtggagctgacaccacagggcacacttgcagagaggatccgtgcaggcggggctggagttcctgcattttacaccccaacagggtatgggaccctggtacaagaaggaggatcgcccatcaaatacaacaaagatggcagtgttgccattgccagtaagccaagagaggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgcaacaagcttttccaggagaaggaccttgttttgatctgactctagcaccctagtatacagcaacacttatactagacattcagtaagttgaattgattgaagataagtgaat

SEQ ID NO: 2631 - DNA, 804 bp, Artificial Sequence
  Synthetic polypeptide
atgatggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgcaacaagcttttccaggagaaggaccttgttttgatctgactctagcaccctagtatacagcaacacttatactagacattcagtaagttgaattgattgaagataagtgaat

SEQ ID NO: 2632 - DNA, 719 bp, Artificial Sequence
  Synthetic polypeptide
atggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccgtaagtttattttctggagagggtcagtctttaggctggggtatgcaggcacatttgaaaacatgtacgtactatacgtgaggaccccactccctccctagcttccttcttcctctcaactcccagaattctggcagtcaggcttcagacttttcaggcaggatattagaagattgttttagaggaatctgtcctgcctaagaggaaagagctaaaggtttgtccagtaaaacagctgcatagggtcatctggtaaaataaagcccacagtagataaatcccagggcactcacccagaggttccagtcaacttttggtgccccactcttgaatatgggctgataaccaaagggtcaccagac

SEQ ID NO: 2633 - DNA, 668 bp, Artificial Sequence
  Synthetic polypeptide
atggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccgtaagtttattttctggagagggtcagtctttaggctggggtatgcaggcacatttgaaaacatgtacgtactatacgtgaggaccccactccctccctagcttccttcttcctctcaactcccagaattctggcagtcaggcttcagacttttcaggcaggatattagaagattgttttagaggaatctgtcctgcctaagaggaaagagctaaaggtttgtccagtaaaacagctgcatagggtcatctggtaaaataaagcccacagtagataaatcccagggcactcacccagaggttccagtcaacttttggtgccccactcttgaatatgggctgataaccaaagggtcaccagac

SEQ ID NO: 2634 - DNA, 692 bp, Artificial Sequence
  Synthetic polypeptide
atgaagtgtgactccagagcctacttgttgggacagcagagtgtaagtggctggggtctgcagccccgtttccaggaatatattattcgagtgcaaagaggaatttctgtggaaaacagctggcagattgttagaagatacagtgactttgatttgcttaacaacagcttacagaacccctggaaggttccagcattggcagtaccaggtgctgcccccagagtggggtgaaggtcaaggagttgcaagtctgtttaagaagcagtcagatccccaaatctcccatgtccgtacaacttatgcctgccctcctccctctagcaaaaaaccgtaagtttattttctggagagggtcagtctttaggctggggtatgcaggcacatttgaaaacatgtacgtactatacgtgaggaccccactccctccctagcttccttcttcctctcaactcccagaattctggcagtcaggcttcagacttttcaggcaggatattagaagattgttttagaggaatctgtcctgcctaagaggaaagagctaaaggtttgtccagtaaaacagctgcatagggtcatctggtaaaataaagcccacagtagataaatcccagggcactcacccagaggttccagtcaacttttggtgccccactcttgaatatgggctgataaccaaagggtcaccagac

SEQ ID NO: 2635 - DNA, 1413 bp, Artificial Sequence
  Synthetic polypeptide
atggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgggtcttactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtgacccgaccaatcccacggattcacatgccgtctgtgcatggccgattctcacatttgctctctggcctcaacttccccagcgcctgctgggcatttcccccaggatgccgaagagatcgatccaaaccgaatgcatggacccacctgactcccgccactctccgaccccgcaccctctccccgcggagggctccagctcagtgaacaggagctcacgtcaccacggggaccaaaatgccgggattcatcctcctttttttccacgtctgcacccagtccagtacaaatcctgtctacgacaccttcaagatctgcatctgaccaagtcccagcccctcgtcctcactctagtccaggtccctggctcccccagctgacccccaaccttgcaaggggtggccggatcctctacccggaagtcagtgaccctttaaacgccaataaggtccccatgctctcaaccctccaacggcttctgcctcccagctggggcacattccagatctctgctgcgggtgatgtgcggcctgaaggatgtggccctggttcctcctgagct

SEQ ID NO: 2636 - DNA, 1296 bp, Artificial Sequence
  Synthetic polypeptide
atggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgtgaactccggagacggcattgactacagccagcagaagagggagaacattggggacttgatccaggagacactggaggccttcgagcgctacggaggagaaaatgcctttatcaacattaagtgacccgaccaatcccacggattcacatgccgtctgtgcatggccgattctcacatttgctctctggcctcaacttccccagcgcctgctgggcatttcccccaggatgccgaagagatcgatccaaaccgaatgcatggacccacctgactcccgccactctccgaccccgcaccctctccccgcggagggctccagctcagtgaacaggagctcacgtcaccacggggaccaaaatgccgggattcatcctcctttttttccacgtctgcacccagtccagtacaaatcctgtctacgacaccttcaagatctgcatctgaccaagtcccagcccctcgtcctcactctagtccaggtccctggctcccccagctgacccccaaccttgcaaggggtggccggatcctctacccggaagtcagtgaccctttaaacgccaataaggtccccatgctctcaaccctccaacggcttctgcctcccagctggggcacattccagatctctgctgcgggtgatgtgcggcctgaaggatgtggccctggttcctcctgagct

SEQ ID NO: 2637 - DNA, 2466 bp, Artificial Sequence; identical to SEQ ID NO: 1682
  Synthetic polypeptide

SEQ ID NO: 2638 - DNA, 1806 bp, Artificial Sequence; identical to SEQ ID NO: 1683
  Synthetic polypeptide

SEQ ID NO: 2639 - DNA, 2412 bp, Artificial Sequence; identical to SEQ ID NO: 1684
  Synthetic polypeptide

SEQ ID NO: 2640 - DNA, 2211 bp, Artificial Sequence; identical to SEQ ID NO: 1685
  Synthetic polypeptide

SEQ ID NO: 2641 - DNA, 364 bp, Artificial Sequence; identical to SEQ ID NO: 1686
  Synthetic polypeptide

SEQ ID NO: 2642 - DNA, 1288 bp, Artificial Sequence
  Synthetic polypeptide
atgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2643 - DNA, 625 bp, Artificial Sequence
  Synthetic polypeptide
atggagtgtggtatacctccaacccttgtatgcgttgggagaggagggggactacacacgatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2644 - DNA, 700 bp, Artificial Sequence
  Synthetic polypeptide
atggagtgtggtatacctccaacccttgtatgcgttgggagaggagggggactacacacggtaggggtatttcatgttctttctcaattgatttccttgtgtaccattccggaggtctttaaagaaaagcccaagatcaatataatcatctggtattattttccttctgcctggaggacttgctttaacatttcaagtagtgtgggtctgctgctgacgaattcatacaaattttatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2645 - DNA, 778 bp, Artificial Sequence
  Synthetic polypeptide
atggagtgtggtatacctccaacccttgtatgcgttgggagaggagggggactacacacggtaggggtatttcatgttctttctcaattgatttccttgtgtaccattccggaggtctttaaagaaaagcccaagatcaatataatcatctggtattattttccttctgcctggaggacttgctttaacatttcaagtagtgtgggtctgctgctgacgaattcatacaaattttgtcctagagacaggaggcatgccatacatggcaacatggggaagaccagagtggtcaggaggcagaaacaggagcaagatacgacgacatattccacagagcgatccgagcacttcaaaccctgccgagacaaggaccttgcatactgtctcaatgatggcgagtgctttgtgatcgaaaccctgaccggatcccataaacactgtcggtgcaaagaaggctaccaaggagtccgttgtgatcaatttctgccgaaaactgattccatcttatcggatccaacagaccacttggggattgaattcatggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2646 - DNA, 238 bp, Artificial Sequence
  Synthetic polypeptide
atggagagtgaagaagtttatcaaaggcaggtgctgtcaatttcatgtatcatctttggaattgtcatcgtgggcatgttctgtgcagcattctacttcaaaagcaagaaacaagctaaacaaatccaagagcagctgaaagtgccacaaaatggtaaaagctacagtctcaaagcatccagcacaatggcaaagtcagagaacttggtgaagagccatgtccagctgcaaaataaaa

SEQ ID NO: 2647 - DNA, 750 bp, Artificial Sequence; identical to SEQ ID NO: 1060
  Synthetic polypeptide

SEQ ID NO: 2648 - DNA, 296 bp, Artificial Sequence; identical to SEQ ID NO: 1061
  Synthetic polypeptide

SEQ ID NO: 2649 - DNA, 364 bp, Artificial Sequence
  Synthetic polypeptide
atggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcagtgcccatactccatagcatggtgcaaaaattcccaggcgtgtcatttgggatcagcactgattctgaggttctgacacactacaacatcactgggaacaccatctgcctctttcgcctggaaactacttctcctgatcctcctgctgctt

SEQ ID NO: 2650 - DNA, 1237 bp, Artificial Sequence
  Synthetic polypeptide
atgaagctactaaccagagccggctctttctcgagattttattccctcaaagttgcccccaaagttaaagccacagctgcgcctgcaggagcaccgccacaacctcaggaccttgagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctgacgacaaaaggagcttcatctttcaagataacccgtggaattgaagcagttggtggcaaattaagtgtgaccgcaacaagggaaaacatggcttatactgtggaatgcctgcggggtgatgttgatattctaatggagttcctgctcaatgtcaccacagcaccagaatttcgtcgttgggaagtagctgaccttcagcctcagctaaagattgacaaagctgtggcctttcagaatccgcagactcatgtcattgaaaatttgcatgcagcagcttaccggaatgccttggctaatcccttgtattgtcctgactataggattggaaaagtgacatcagaggagttacattacttcgttcagaaccatttcacaagtgcaagaatggctttgattggacttggtgtgagtcatcctgttctaaagcaagttgctgaacagtttctcaacatgaggggtgggcttggtttatctggtgcaaaggccaactaccgtggaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtttctgcatttaatgccagttactcagattctggactctttgggatttatactatctcccaggccacagctgctggagatgttatcaaggctgcctataatcaagtaaaaacaatagctcaaggaaacctttccaacacagatgtccaagctgccaagcacagtggctcactaatcccagcactttgggaggccaaggcaggtggttcatttgagaccaggagtttgagaccagcttgggcaacatagcaagacctcgtctccaccaaaa

SEQ ID NO: 2651 - DNA, 192 bp, Artificial Sequence
  Synthetic polypeptide
atgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaatgtggagaa

SEQ ID NO: 2652 - DNA, 565 bp, Artificial Sequence; identical to SEQ ID NO: 1420
  Synthetic polypeptide

SEQ ID NO: 2653 - DNA, 1201 bp, Artificial Sequence
  Synthetic polypeptide
atggtgtgcttccgcctcttcccggttccgggctcagggctcgttctggtctgcctagtcctgggagctgtgcggtcttatgcattggaacttaatttgacagattcagaaaatgccacttgcctttatgcaaaatggcagatgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2654 - DNA, 868 bp, Artificial Sequence
  Synthetic polypeptide
atggtgtgcttccgcctcttcccggttccgggctcagggctcgttctggtctgcctagtcctgggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2655 - DNA, 744 bp, Artificial Sequence
  Synthetic polypeptide
gcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2656 - DNA, 1060 bp, Artificial Sequence
  Synthetic polypeptide
atgaatttcacagtacgctatgaaactacaaataaaacttataaaactgtaaccatttcagaccatggcactgtgacatataatggaagcatttgtggggatgatcagaatggtcccaaaatagcagtgcagttcggacctggcttttcctggattgcgaattttaccaaggcagcatctacttattcaattgacagcgtctcattttcctacaacactggtgataacacaacatttcctgatgctgaagataaaggaattcttactgttgatgaacttttggccatcagaattccattgaatgacctttttagatgcaatagtttatcaactttggaaaagaatgatgttgtccaacactactgggatgttcttgtacaagcttttgtccaaaatggcacagtgagcacaaatgagttcctgtgtgataaagacaaaacttcaacagtggcacccaccatacacaccactgtgccatctcctactacaacacctactccaaaggaaaaaccagaagctggaacctattcagttaataatggcaatgatacttgtctgctggctaccatggggctgcagctgaacatcactcaggataaggttgcttcagttattaacatcaaccccaatacaactcactccacaggcagctgccgttctcacactgctctacttagactcaatagcagcaccattaagtatctagactttgtctttgctgtgaaaaatgaaaaccgattttatctgaaggaagtgaacatcagcatgtatttggttaatggctccgttttcagcattgcaaataacaatctcagctactgggatgcccccctgggaagttcttatatgtgcaacaaagagcagactgtttcagtgtctggagcatttcagataaatacctttgatctaagggttcagcctttcaatgtgacacaaggaaagtattctacaggtcacatctggcagcctcagctctctggattcttaacagaaccaagaagcaagtaaaacaaataattgaactggcagcccaagtcaatgtcagaaaagtttataaact

SEQ ID NO: 2657 - DNA, 1111 bp, Artificial Sequence; identical to SEQ ID NO: 1156
  Synthetic polypeptide

SEQ ID NO: 2658 - DNA, 1138 bp, Artificial Sequence; identical to SEQ ID NO: 1157
  Synthetic polypeptide

SEQ ID NO: 2659 - DNA, 1345 bp, Artificial Sequence; identical to SEQ ID NO: 1158
  Synthetic polypeptide

SEQ ID NO: 2660 - DNA, 1249 bp, Artificial Sequence; identical to SEQ ID NO: 1159
  Synthetic polypeptide

SEQ ID NO: 2661 - DNA, 97 bp, Artificial Sequence
  Synthetic polypeptide
atgttctctccctggaagatatcaatgtttctgtctgttcgtgaggactccgtgcccaccacggcctctttcaggctcattctctaccctccagcca

SEQ ID NO: 2662 - DNA, 686 bp, Artificial Sequence
  Synthetic polypeptide
atgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggactccgtgagaccagagtcctgtccatctggttcattgcagccacctcaggacagaacacagatcctggcacccagtagatgtgctcaataattacttgctgaattaataaa

SEQ ID NO: 2663 - DNA, 167 bp, Artificial Sequence
  Synthetic polypeptide
atggccatggagatagacagcaggcctggggggctccccggcagtagctgcaacctaggtgcagcccgagaacacatgcaggcggtcacccgaaactacatcacccacccccgtgtcacttagtacatagaaggcatccatgcagtagatatgcttgaagaaaggaa

SEQ ID NO: 2664 - DNA, 361 bp, Artificial Sequence
  Synthetic polypeptide
atgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaaacccatttaggggcagggcagcaatgtgccctgtggaaaatactcccctgaccag

SEQ ID NO: 2665 - DNA, 357 bp, Artificial Sequence
  Synthetic polypeptide
cgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaaacccatttaggggcagggcagcaatgtgccctgtggaaaatactcccctgaccag

SEQ ID NO: 2666 - DNA, 265 bp, Artificial Sequence
  Synthetic polypeptide
atggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaaacccatttaggggcagggcagcaatgtgccctgtggaaaatactcccctgaccag

SEQ ID NO: 2667 - DNA, 496 bp, Artificial Sequence
  Synthetic polypeptide
atggggagcctcagcggtctgcgcctggcagcagcttcacaatagtcttgaaaaccaacagcctcacaaatcacagttactttgaaaaccagcagccttgcaggcactgaagaaggcagaatgggtttaagagttttccaaaacttccagctgcagagaattgttactatttgacttgtctgacagttcgctggaaaccccactcacagggcttatcttttttcacctgacttggagtttattcactgcaaacagtgttttccctggtgcatttgttgaaaataatcagcagcacttgtttgacataacatggagtgggtaacagctgggtcaaacaagaagctggggaatgagatgtccatcctgacatctggaaagctctgacatatttctagaatgtaatatgtgtaaggttggacacattttccaggaaaaacctgagaggtctctaagctctcacctcacatttagtctctgtccgagcacgaatggaagg

SEQ ID NO: 2668 - DNA, 1136 bp, Artificial Sequence
  Synthetic polypeptide
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagca

SEQ ID NO: 2669 - DNA, 426 bp, Artificial Sequence
  Synthetic polypeptide
atgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2670 - DNA, 705 bp, Artificial Sequence
  Synthetic polypeptide
atggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2671 - DNA, 459 bp, Artificial Sequence
  Synthetic polypeptide
atgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2672 - DNA, 636 bp, Artificial Sequence
  Synthetic polypeptide
atggcggtggaaggaggaatgaaatgtgtgaagttcttgctctacgtcctcctgctggccttttgcggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacctactcaggagggtgaggcaggagaatcgcttgaacccgggaggcggaggttgcagtgagccgagattgagccaccgctgggcacttgtctgggcaacagagcaagtctctgtctcaaaaaaaaaaaaaaaaaaaaaaaaagaa

SEQ ID NO: 2673 - DNA, 3378 bp, Artificial Sequence
  Synthetic polypeptide
atgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaaggagacttctttatttaacctgtggaaagcatcatgactgcctgaaaggagagacaaagaggggagaagggactaccttccccagccctggaaactctgctcggtaactcaggcaaaggagccaaatcacaatagctaatttgtgccacaggtcccttgggcacgaacctctagccagacttctgtcactgttgggataatcattttcagactctcccatttggggcagacagtgccctgaccatttgctagaggcaaggcaaacctgggcttaagatatcacctatagccaagaaaaaggcaatagtagtgaagatttgctaagaaaatatatccaataaaaaccaagacaagttgaatagaggaagctggaataaataaccaatccttcaatgcaaagacatagacatatacccacaagaaacaacactgaatagggaaatgtgacctctgcaaaaggacaaaggaaaaatccagtgaccgaccctaacaagacagtcatttgtgagctctctgaccaaaaattcaaaagagcagtttcaaggaaattcagtgatctctaaaataatacagaaaagcaattcagaaaattgctggagaaatttaacaaagagaatttgttaaatttttaaagttaactttaaaaactcaaacaaattttggaactgagaaatacgtttgctgagctgaacaactaattagaggctctcaacatccaaatggaacaaccagagggaagaatcagtgagctcaaagaccagctatttgaaaatacagtcagaggagaaaaaagaaaaaagaaagaaaaagaacaaaaactgcctacaagatatagaaaattacctcaaaaaccaaatctaagaattcttgatgttcaaaagggagctgagcaaaggcagagggcagaaagaaaaaatacaaaattttccagagcttgagaaagatataaatctccagtacgggaaggtctgataatacccaagagattcaacccaaataagactaccccaaggtatgtaataaccaaactctcaaaggtcaaggacaaagagaggatctcaaaagcagcaagagaaaagaagcaaataacatataaaggacctccaattcttctggtaacagacttttcaatgaaaaaccatacagacaggagggagtggaacaacatattcaaagtgctcaaagaaaaaaaaagccatctaagaacactgtatccagcaaaattaccctttgaatatgaaggagaaatagtctttcccaaacaactaaagttcagagaatccacccccatcagacccatcatcttacagtaaatggtaaagggggttcttcaatctgaaaggaaaaaaaacaacattaacatacaaaaagaaaactttcctttatttacccactggtaaaattaagtacatgaatacttaattttaagaattctctagaatactgagaatactctgttacaataattgtggtgtgtaagcactcataactctagtatgaagcccaatcaaaaacaatagctatagcaacctgttaagagatgtaatataaaaatatgtaaattgagacaactaagtcaaaatgtggcattttgtgtgtatgtgtgtttgtctttgtttctattcctttctttgtaatccaaaatattatctctttaaaataactttttatatctatacaatgttttttgtaaccctcctggtaaccacagcccaaaaacctacaatatattcactaaaaataaaaaacaacaaattaaaacgtactatcagagaaagtaaccaccaaagaagacagtaggaaagaaaagaaaggagtcttaaaactatcagaaaataggcaacaaaatggcagtagtaagtctttacttaatagtaacactgaatgtaaatggtctcaattttcaaataaaaagcttagaatggctgaaggaattaaaaaagcaagaccaaactatatgctgccttcaagaaactctcttcacttataaagacacacagactgaaagagaagcagtgaaaaatgatattccatgcaactggaaaccaaaaatagcaggagtagctatacttatataaaatagactacaaatctaagattgtaaaaagagacaaagatgatcatgaaaggggtcaattaagcaagagggtataacaattataaatatctatgcacacaacaccagaactcctaggtatataaagcaaacattaatatctaaaagggtagactgcaatataataatagtagcggactttaacaccccactctcagtaatggacagatcatccagacagaaaatcaacaaagagcataaactacacactagaataggcctaactaacatttacagaacatttcacccatatgatagctaacttcatactgtgtattttgtgctgcagaatacatattcttttcatcagcacatggaatattcttcagaatagaccatatcttaggccacaaaatatatctgaaaaaattttcaaaatagaaatcatatcaagtagcttttctgaccacaatgaaataaaactagaaatcagtaacaagaggaactttggaaaatgcacaaacacatggaaattatacaacatggtcttaaatggccaatgaaaaagttaagaaggaacttttaaaatttcttcaaacaaataaatgaaaatggaaataaaacataccaaaatctatggggtatggcaagagcccagtaccaagagggaagtttatagcaataaatgcctgtatcaaaaaagtagaaagacttcaaataaaataacttaatgttgcacctcaaggcactagaaaagaaagaacaaaccccaaactggtagaaggaaagaaacaataaagatcagagcagaaatacatgaaactaagactaaaaaaaaaaaaaaaaaaaaaacaaaaaaaaaacagaagataaaacctttcgctagattaagtaggaagagcacaaacctgaataaataaaatcagaaatgaaaaaggagacataataactgagacctcagaaatacaaagaatcattagcaagtattatgaacaaatatatgccaacaaattggaaaacttagaagaaatggatacattcctggacacatacaacctatcaagattgaatca

SEQ ID NO: 2674 - DNA, 3570 bp, Artificial Sequence
  Synthetic polypeptide
atgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaaggagacttctttatttaacctgtggaaagcatcatgactgcctgaaaggagagacaaagaggggagaagggactaccttccccagccctggaaactctgctcggtaactcaggcaaaggagccaaatcacaatagctaatttgtgccacaggtcccttgggcacgaacctctagccagacttctgtcactgttgggataatcattttcagactctcccatttggggcagacagtgccctgaccatttgctagaggcaaggcaaacctgggcttaagatatcacctatagccaagaaaaaggcaatagtagtgaagatttgctaagaaaatatatccaataaaaaccaagacaagttgaatagaggaagctggaataaataaccaatccttcaatgcaaagacatagacatatacccacaagaaacaacactgaatagggaaatgtgacctctgcaaaaggacaaaggaaaaatccagtgaccgaccctaacaagacagtcatttgtgagctctctgaccaaaaattcaaaagagcagtttcaaggaaattcagtgatctctaaaataatacagaaaagcaattcagaaaattgctggagaaatttaacaaagagaatttgttaaatttttaaagttaactttaaaaactcaaacaaattttggaactgagaaatacgtttgctgagctgaacaactaattagaggctctcaacatccaaatggaacaaccagagggaagaatcagtgagctcaaagaccagctatttgaaaatacagtcagaggagaaaaaagaaaaaagaaagaaaaagaacaaaaactgcctacaagatatagaaaattacctcaaaaaccaaatctaagaattcttgatgttcaaaagggagctgagcaaaggcagagggcagaaagaaaaaatacaaaattttccagagcttgagaaagatataaatctccagtacgggaaggtctgataatacccaagagattcaacccaaataagactaccccaaggtatgtaataaccaaactctcaaaggtcaaggacaaagagaggatctcaaaagcagcaagagaaaagaagcaaataacatataaaggacctccaattcttctggtaacagacttttcaatgaaaaaccatacagacaggagggagtggaacaacatattcaaagtgctcaaagaaaaaaaaagccatctaagaacactgtatccagcaaaattaccctttgaatatgaaggagaaatagtctttcccaaacaactaaagttcagagaatccacccccatcagacccatcatcttacagtaaatggtaaagggggttcttcaatctgaaaggaaaaaaaacaacattaacatacaaaaagaaaactttcctttatttacccactggtaaaattaagtacatgaatacttaattttaagaattctctagaatactgagaatactctgttacaataattgtggtgtgtaagcactcataactctagtatgaagcccaatcaaaaacaatagctatagcaacctgttaagagatgtaatataaaaatatgtaaattgagacaactaagtcaaaatgtggcattttgtgtgtatgtgtgtttgtctttgtttctattcctttctttgtaatccaaaatattatctctttaaaataactttttatatctatacaatgttttttgtaaccctcctggtaaccacagcccaaaaacctacaatatattcactaaaaataaaaaacaacaaattaaaacgtactatcagagaaagtaaccaccaaagaagacagtaggaaagaaaagaaaggagtcttaaaactatcagaaaataggcaacaaaatggcagtagtaagtctttacttaatagtaacactgaatgtaaatggtctcaattttcaaataaaaagcttagaatggctgaaggaattaaaaaagcaagaccaaactatatgctgccttcaagaaactctcttcacttataaagacacacagactgaaagagaagcagtgaaaaatgatattccatgcaactggaaaccaaaaatagcaggagtagctatacttatataaaatagactacaaatctaagattgtaaaaagagacaaagatgatcatgaaaggggtcaattaagcaagagggtataacaattataaatatctatgcacacaacaccagaactcctaggtatataaagcaaacattaatatctaaaagggtagactgcaatataataatagtagcggactttaacaccccactctcagtaatggacagatcatccagacagaaaatcaacaaagagcataaactacacactagaataggcctaactaacatttacagaacatttcacccatatgatagctaacttcatactgtgtattttgtgctgcagaatacatattcttttcatcagcacatggaatattcttcagaatagaccatatcttaggccacaaaatatatctgaaaaaattttcaaaatagaaatcatatcaagtagcttttctgaccacaatgaaataaaactagaaatcagtaacaagaggaactttggaaaatgcacaaacacatggaaattatacaacatggtcttaaatggccaatgaaaaagttaagaaggaacttttaaaatttcttcaaacaaataaatgaaaatggaaataaaacataccaaaatctatggggtatggcaagagcccagtaccaagagggaagtttatagcaataaatgcctgtatcaaaaaagtagaaagacttcaaataaaataacttaatgttgcacctcaaggcactagaaaagaaagaacaaaccccaaactggtagaaggaaagaaacaataaagatcagagcagaaatacatgaaactaagactaaaaaaaaaaaaaaaaaaaaaacaaaaaaaaaacagaagataaaacctttcgctagattaagtaggaagagcacaaacctgaataaataaaatcagaaatgaaaaaggagacataataactgagacctcagaaatacaaagaatcattagcaagtattatgaacaaatatatgccaacaaattggaaaacttagaagaaatggatacattcctggacacatacaacctatcaagattgaatca

SEQ ID NO: 2675 - DNA, 1165 bp, Artificial Sequence
  Synthetic polypeptide
atggaacgtcaggtgctgctgagcgagcccgaggaggcggcggctctgtatcggggccttagccgccagcccgcgctgagcgccgcctgcctgggcccggaggtcaccacgcagtacggcggccaataccggacggtgcacactgagtggacccagagggacctggaacgcatggagaacattcgattctgccgccaatacctggtgttccatgacggggactcagtggtgtttgcaggacctgcaggcaacagtgtggagacccggggggaactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagacagggtcctggcctccctgagctcccatttcttcatggaggggtgattgtgtctgcctgcctcataggatcatagtgagtgttaagtgagtgatgatattaaag

SEQ ID NO: 2676 - DNA, 940 bp, Artificial Sequence
  Synthetic polypeptide
acgccccgcctcgccccggcggcagagaggagactatggaacgtcagactgctgagcagagagtctccttcaggcaccatgaaagctgtgctgcgcaaggctggaggcacgggccctggggaagagaagcagttcctggaggtctgggagaagaaccggaagctcaagagcttcaacctgtcagcgctggagaaacatgggcctgtttatgaggatgactgctttggctgcctgtcctggtcgcactcggagacacacttgttgtatgtggcagagaagaagcgccccaaggccgagtccttctttcagaccaaagccttggacgtcagtgccagcgatgatgagatagccaggctgaagaagccagaccaagccatcaagggggatcagtttgtgttttatgaagactggggagaaaacatggtttccaaaagcatccctgtgctctgcgtgctggatgtcgagagtggcaacatctctgtgcttgagggggtccctgagaatgtgtcccctggacaggcattttgggcccctggagatgctggtgtggtgtttgtgggctggtggcatgagcccttccggttgggcatccgcttttgcaccaatcgcaggtcagccctgtattatgtggacctcatcggggggaagtgtgagctcctctcggatgactccctggctgtctcttctccccggctgagcccagaccaatgtcgcattgtctacctgcagtacccatctctgatcccccatcaccaatgcagccagctgtgcctgtatgactggtataccaaggttacctcagtggtggtagatgttgtgcctcggcagctgggagacagggtcctggcctccctgagctcccatttcttcatggaggggtgattgtgtctgcctgcctcataggatcatagtgagtgttaagtgagtgatgatattaaag

SEQ ID NO: 2677 - DNA, 2937 bp, Artificial Sequence
  Synthetic polypeptide
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttggatacagccctctgcggactgggctggggctgtttggccattataccctcggcttctaggacagtggctgtgacacagcagatgctcaaagaatatct

SEQ ID NO: 2678 - DNA, 2655 bp, Artificial Sequence
  Synthetic polypeptide
atggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttggatacagccctctgcggactgggctggggctgtttggccattataccctcggcttctaggacagtggctgtgacacagcagatgctcaaagaatatct

SEQ ID NO: 2679 - DNA, 314 bp, Artificial Sequence; identical to SEQ ID NO: 998
  Synthetic polypeptide

SEQ ID NO: 2680 - DNA, 228 bp, Artificial Sequence
  Synthetic polypeptide
atgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttcccagaccctccctgctattctctctgcttccgctcttgcctcgttacattccatacttcacacagcag

SEQ ID NO: 2681 - DNA, 914 bp, Artificial Sequence; identical to SEQ ID NO: 931
  Synthetic polypeptide

SEQ ID NO: 2682 - DNA, 251 bp, Artificial Sequence; identical to SEQ ID NO: 932
  Synthetic polypeptide

SEQ ID NO: 2683 - DNA, 1016 bp, Artificial Sequence; identical to SEQ ID NO: 933
  Synthetic polypeptide

SEQ ID NO: 2684 - DNA, 834 bp, Artificial Sequence
  Synthetic polypeptide
atgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgcagaagggacttggcagctgcagttcagttcaaggccttgggatgagaagcgtgtcctggagtatccaggtgggcttggtggagtcccaagggtcctcatgggagggaaggaggagggtgcgagtcagaggagaagtgactatggaagcagagggtggagacgtggctgtgagccaaggagtgctgccagcctctagaagttgaaggcaaggaatggagtctcctctgagaccggcagaggggacgcagctccgctgacacttggattttagcccatgagccccacctcagacttctgggctccagaaccataggagaatacat

SEQ ID NO: 2685 - DNA, 687 bp, Artificial Sequence
  Synthetic polypeptide
atgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgcagaagggacttggcagctgcagttcagttcaaggccttgggatgagaagcgtgtcctggagtatccaggtgggcttggtggagtcccaagggtcctcatgggagggaaggaggagggtgcgagtcagaggagaagtgactatggaagcagagggtggagacgtggctgtgagccaaggagtgctgccagcctctagaagttgaaggcaaggaatggagtctcctctgagaccggcagaggggacgcagctccgctgacacttggattttagcccatgagccccacctcagacttctgggctccagaaccataggagaatacat

SEQ ID NO: 2686 - DNA, 3488 bp, Artificial Sequence
  Synthetic polypeptide
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2687 - DNA, 3305 bp, Artificial Sequence
  Synthetic polypeptide
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2688 - DNA, 3398 bp, Artificial Sequence
  Synthetic polypeptide
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagacttgtgattacctcagaaatgattgaaaatatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2689 - DNA, 313 bp, Artificial Sequence
  Synthetic polypeptide
taaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgaaaccatatcttgatgaatc

SEQ ID NO: 2690 - DNA, 528 bp, Artificial Sequence; identical to SEQ ID NO: 1280
  Synthetic polypeptide

SEQ ID NO: 2691 - DNA, 438 bp, Artificial Sequence; identical to SEQ ID NO: 1281
  Synthetic polypeptide

SEQ ID NO: 2692 - DNA, 1380 bp, Artificial Sequence
  Synthetic polypeptide
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaacatcccaaaagtcaaccaaaggaaaacagatgaacaattgttgacttgccattcagtggaacactgccagcaat

SEQ ID NO: 2693 - DNA, 1230 bp, Artificial Sequence
  Synthetic polypeptide
atgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaacatcccaaaagtcaaccaaaggaaaacagatgaacaattgttgacttgccattcagtggaacactgccagcaat

SEQ ID NO: 2694 - DNA, 397 bp, Artificial Sequence
  Synthetic polypeptide
atgctcgaaggtgcggagctgtacttcaacgtggaccatggctacctggagggcctggttcgaggatgcaaggccagcctcctgacccagcaagactatatcaacctggtccagtgtgagaccctagaaggtctacaggatgctttccaagggttatggagacaggagtgattataagatgaccactttccagatcctgagtgcctatatgtatatatactaaaactacctaagagtacttgaagtcagaacactgtgctgggttccccttatcacctccttatcacaactgttctttttccaccatccttttacaccatactatgatgtatagccctgaggtataaaaagctttagggcactaaacaaaccacaggaccatttgaagtgttagtgt

SEQ ID NO: 2695 - DNA, 561 bp, Artificial Sequence
  Synthetic polypeptide
atgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgatgctttccaagggttatggagacaggagtgattataagatgaccactttccagatcctgagtgcctatatgtatatatactaaaactacctaagagtacttgaagtcagaacactgtgctgggttccccttatcacctccttatcacaactgttctttttccaccatccttttacaccatactatgatgtatagccctgaggtataaaaagctttagggcactaaacaaaccacaggaccatttgaagtgttagtgt

SEQ ID NO: 2696 - DNA, 661 bp, Artificial Sequence
  Synthetic polypeptide
atggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2697 - DNA, 786 bp, Artificial Sequence
  Synthetic polypeptide
atggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccaggtcaagaaatacttcgttacttcatattacacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2698 - DNA, 757 bp, Artificial Sequence
  Synthetic polypeptide
atggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaagaggggttcgagttctggagcctggatgtgaatggaggcgatgagtggaaggtggaggatctctctcgagaccagaggaaggaattccccaatgaccagcacctgcctcaagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2699 - DNA, 432 bp, Artificial Sequence
  Synthetic polypeptide
tgcacaggaacctcctgcacaacccgtgcgctgaagaggggttcgagttctggagcctggatgtgaatggaggcgatgagtggaaggtggaggatctctctcgagaccagaggaaggaattccccaatgaccaggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2700 - DNA, 385 bp, Artificial Sequence
  Synthetic polypeptide
caagtcccaggtggtggacctcaaggccgaagggtattgggaggagctgatggataccacacggccggacatcgaggtcaaggactggttcgcagccaggccagattgcgggtccaagtaccagctgtgcgttcagctcctgtcgtccgcgcacgcgcctctggggaccttccagccagacccggcgaccatccagcagaagagcgatgccaagtggagggaggcgtggtggcacatgccagctacttgggaggctgaggcagaagaatcgcttgaatccaggaggcggaggttgccgtgagccgagatcgcgccattgcactccagcctgggcaacaagagcgaaactccatctcaacaaaaaaagaaaagaaaagaaaaaaaa

SEQ ID NO: 2701 - DNA, 37 bp, Artificial Sequence; identical to SEQ ID NO: 1671
  Synthetic polypeptide

SEQ ID NO: 2702 - DNA, 1420 bp, Artificial Sequence; identical to SEQ ID NO: 924
  Synthetic polypeptide

SEQ ID NO: 2703 - DNA, 1336 bp, Artificial Sequence; identical to SEQ ID NO: 925
  Synthetic polypeptide

SEQ ID NO: 2704 - DNA, 1069 bp, Artificial Sequence; identical to SEQ ID NO: 926
  Synthetic polypeptide

SEQ ID NO: 2705 - DNA, 1345 bp, Artificial Sequence; identical to SEQ ID NO: 927
  Synthetic polypeptide

SEQ ID NO: 2706 - DNA, 941 bp, Artificial Sequence
  Synthetic polypeptide
atgaacaaaacaaaccaagtgtatgcagcaaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtcacaaagctccttctcaaacttgttctggaggaagccagcagccatgtcataaggaagctcaagcagccatatggagagcccacatgggaagggacagaggcctcctgcccacagccgtggagatgaaccaccttggagacagctcccccagccccaacacacgcagatgatcatggtcctggctgacatcttcactgcaacctcacgagagacccaagccacaacttcccagctgagcccacagatgtggtatgagatgatgtgcttgtcggcttaagctgttatggctttggggtgattcgttagcagcactggataact

SEQ ID NO: 2707 - DNA, 913 bp, Artificial Sequence
  Synthetic polypeptide
caaatgaggatcataactctcagtttattgatgattattcatcctcagatgagagtttatccgtcagccacttcagtttctctaaacagagccacagaccaagaactataagagacagaactagtttttcttcaaaattgcctagccataataagaaaaatagcacttttattccaagaaaaccaatgaaatgttcaaatgagaaagttgttaatcaagagcagtcgtatgaatcaatggataaatttttagatggcgttcaggaagtggcttatattcactcaaaccagaatgtaattggatcgagcaaagctgaaaatcacatgagccgatgggcagcacatgacgtatttgagttgaagcagttttctcagctgcctgctaacatagctgtttgcagttctaagacatataaagaaaaagtggatgcagatacattgccacacacaaagaaaggccagcaaccgagtgaaggcagcatttcacttcctctttacatttcaaatcctgtaaaccagaagaagaaaaaagtctaccatacaaaccagaccaccttcataattggagaaacaccaaaaggaatccgcaggtcacaaagctccttctcaaacttgttctggaggaagccagcagccatgtcataaggaagctcaagcagccatatggagagcccacatgggaagggacagaggcctcctgcccacagccgtggagatgaaccaccttggagacagctcccccagccccaacacacgcagatgatcatggtcctggctgacatcttcactgcaacctcacgagagacccaagccacaacttcccagctgagcccacagatgtggtatgagatgatgtgcttgtcggcttaagctgttatggctttggggtgattcgttagcagcactggataact

SEQ ID NO: 2708 - DNA, 3947 bp, Artificial Sequence
  Synthetic polypeptide
atgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgccgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctcaccttcagcagcatctatgccctcatccagcactaccgcgagacgcacctgcgctgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatatggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaagcagcagggcgatcctccggtggagtttgccacagacagggtggaggagctctttgagtggtttcagagcatccgagagatcacctggaagattgacaccaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaatgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatgacaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccagctccagctgtaccaggagaaatgcaacaagagggttgattcggctgatctggctggctaggtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagat

SEQ ID NO: 2709 - DNA, 609 bp, Artificial Sequence; identical to SEQ ID NO: 249
  Synthetic polypeptide

SEQ ID NO: 2710 - DNA, 738 bp, Artificial Sequence; identical to SEQ ID NO: 250
  Synthetic polypeptide

SEQ ID NO: 2711 - DNA, 537 bp, Artificial Sequence; identical to SEQ ID NO: 251
  Synthetic polypeptide

SEQ ID NO: 2712 - DNA, 684 bp, Artificial Sequence; identical to SEQ ID NO: 253
  Synthetic polypeptide

SEQ ID NO: 2713 - DNA, 285 bp, Artificial Sequence; identical to SEQ ID NO: 255
  Synthetic polypeptide

SEQ ID NO: 2714 - DNA, 552 bp, Artificial Sequence; identical to SEQ ID NO: 254
  Synthetic polypeptide

SEQ ID NO: 2715 - DNA, 1871 bp, Artificial Sequence
  Synthetic polypeptide
atggcagaggctggggatgctgcgctatcggtggccgagtggctgcgggcattgcacctggagcagtacacggggctctttgagcagcatggcctggtgtgggccactgagtgccaaggcctcagcgacacccgcctgatggacatgggcatgctactccctggtcaccgccgccgcatcctggctggcctgctccgtgcccatacctcaccggcccctgcaccccgccccaccccacggcctgtgcccatgaagcgccacatcttccgctcaccacctgtgcctgccactccacccgagccgctgcccaccactacagaggatgaggggctccccgctgccccacccatcccgccccggaggagctgccttccgcccacctgcttcaccaccccatccacagctgccccagaccctgtgctgcccccgctgcctgctaagcggcatttggcagagctgagcgttccacccgtgccgccccgcaccggacccccccgcctgctggtgagcctgcccactaaggaggaggagtcattgctgccatcattatcatcccctccccagccacagtctgaggagcccctgtccaccctcccccaggggcctccccagcctccctctccacctccctgccccccggagatacctccaaagccggtacgcctgttcccagagttcgatgactctgactacgatgaggtcccagaggaggggccgggggccccagccagagtgatgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagcaccccatacaggacctgacaaggaggcaaggtggggggcctaggaaatggctgtggaatga

SEQ ID NO: 2716 - DNA, 1151 bp, Artificial Sequence
  Synthetic polypeptide
atgacgctgagtgggtctcgggggcaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagcaccccatacaggacctgacaaggaggcaaggtggggggcctaggaaatggctgtggaatga

SEQ ID NO: 2717 - DNA, 1136 bp, Artificial Sequence
  Synthetic polypeptide
atgaccaagaaggaggagcccccaccgagccgagtcccacgggccgtgcgcgtggccagtctgctgagcgagggagaggaactgtctggggacgaccaaggggatgaggaagaggatgaccacgcctatgagggcgtccccaatggcggatggcataccagcagcctgagcttgtccttgcccagcacaatagctgcgccacaccccatggacgggccgcctgggggctccacccccgtcacaccagtcatcaaggctggctggctggacaagaacccaccgcagggatcttacatctatcagaaacgatgggtgagactggatactgatcacctgcgatactttgacagtaacaaggacgcttactctaagcgctttatctctgtggcctgcatctcccacgtggctgccatcggggaccagaagtttgaagtgatcacaaacaaccgaacctttgccttccgggcagagagtgatgtggagcggaaggagtggatgcaggccctgcagcaggccatggctgagcagcgtgcccgggcccggctctctagcgcttatctgctgggagttccaggctcagagcagcctgaccgcgctggcagcctggagcttcgtggcttcaagaataagctgtacgtggccgtggtcggggacaaagtgcagctctacaagaatctagaggagtaccacctgggcattggcatcaccttcatcgacatgagcgtgggcaacgtgaaggaagtggaccggcgcagcttcgacctcaccacgccctaccgcatcttcagcttctctgctgactcagagctagagaaggagcagtggttggaggccatgcagggagccatcgctgaggccctgtctacctcggaggtggccgagcgcatctgggctgcagcccccaacaggttctgtgctgactgcggggctcctcagcctgactgggcctccatcaacctctgtgttgttatctgcaagcgctgtgcaggggagcaccgtggcctgggcgctggcgtctccaaggtgcggagcctgaagatggacaggaaggtgtggacagaaacacttatcgagcaccccatacaggacctgacaaggaggcaaggtggggggcctaggaaatggctgtggaatga

SEQ ID NO: 2718 - DNA, 2264 bp, Artificial Sequence
  Synthetic polypeptide
atgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2719 - DNA, 3257 bp, Artificial Sequence
  Synthetic polypeptide
atggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttctatttcagactggttaagaaccattgctggggaactagtgcagtcatttggagcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2720 - DNA, 3296 bp, Artificial Sequence
  Synthetic polypeptide
atggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatattcatcaggtgcaaactgcggacctgcggcgagtgtctgctccccccggctccttcaccattccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgcaacttctgctgatcgcttttatcgaatagacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2721 - DNA, 3203 bp, Artificial Sequence
  Synthetic polypeptide
atggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggaaagcaatctcccgggcaggcctccagcatctggctcctgcacatcccctcagccttcctgtggcaaatggtccagccaaggagcccagagcgactttggactggagtgagaatgccgtgaatggagaacacctgtggctggagaccaacgtctcgggagacctctgctaccttggagaggagaactgccaagtcagatttgcaaaatcagctctcaggaggaagtgtgcagtctgtaaaatcgtcgtccacaccgcctgcattgagcagctagaaaagattaatttcagatgtaaaccaacatttcgagaaggaggctcaaggtcaccaagagaaaattttgtacgtcatcactgggtgcacaggcgtcggcaggaggggaaatgtaagcagtgtggtaagggcttccagcaaaagttctccttccacagtaaagagattgtggctatcagctgttcctggtgcaagcaggcgtttcacaataaggtgacctgcttcatgctgcatcacattgaagaaccctgctccctgggggctcatgctgctgttattgtcccgcccacttggatcattaaggtgaagaaacctcagaactccctgaaggcttcaaatcggaagaagaagagaacaagctttaaaagaaaagccagtaaaagagggatggaacaggaaaacaaaggtcgtccttttgtgataaaacccatctcttctcctctcatgaaacccttgcttgtatttgtgaatcccaagagtggaggcaaccagggaaccaaagtcctgcagatgttcatgtggtacctgaatccacggcaagtctttgatctttctcaggaagggccaaaagatgcgcttgaattgtataggaaagtaccaaatctgcgaattctggcctgtggtggggatggaacggtgggctggatcctttccatcctggatgaactgcagctgagccctcagcctcctgtgggggtccttcctctggggactgggaatgacctggctcgaactctcaactggggagggggctacactgatgaacctgtttctaagatcctgtgtcaagtggaagatgggacagttgtacagctagatcgctggaacctccatgtggaaagaaaccccgacttgcctccagaagaacttgaagatggcgtatgtaagctccctctgaatgttttcaataactacttcagccttggatttgatgcccatgtcacactggagttccatgaatccagagaagcaaatccagagaaattcaacagtcgttttcgaaataaaatgttctatgcaggggcagctttttctgacttcctacagagaagttctagagatctatccaaacatgttaaagttgtttgtgatggaacagatctcaccccaaagattcaggaactgaagttccagtgtatagtatttttaaatatacccagatattgtgctggcacaatgccctggggaaacccaggtgatcaccatgatttcgaacctcagcgtcatgatgatggttatattgaagtcattggatttaccatggcctctttggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgatccccagtctgtcccagatcgtctgaggatccgggtgaacaaaatcagtttacaagactatgaaggattccactatgacaaggagaaactccgagaagcttcgatacctctgggtattctagttgtgcgtggagactgtgatttggagacttgccgtatgtacatagaccgcctacaggaggacctacagtcagtttcttctggctcccagagagttcattaccaggaccatgaaacctccttccccagggctctctcagcacagaggctctctcctcggtggtgcttcctagatgacagatctcaggaacatttgcactttgtgatggagatttcccaagatgagatttttattctggacccagatatggtggtgtcacagccggcggggacacctccgggcatgcctgacctggtggtggaacaagcctcggggatctcagactggtggaatcctgccctgcggaaacgcatgctgagtgacagtgggctggggatgatagctccctattatgaggactcagatctgaaagatctcagccactcccgcgtgctacagtcaccagtctcttcagaagatcatgcaattttgcaggcagtaatagctggtgatcttatgaagctaatagaaagctataaaaatggaggcagtctgctaattcagggaccagaccactgttcactccttcactacgcagctaaaaccggcaacggggagattgtgaaatatatccttgaccacggaccttccgagttattggatatggcagacagtgaaacgggtgagactgcactgcacaaggctgcctgccagcggaaccgggctgtgtgccagcttctggtggatgcaggagcatctctgagaaagacggactccaaggtctccttcctgccacctagtgaagaagttgcctttcttccctttgccttccagcatgattgtaaagcttcctgaggcctccccagccatgctgaactgtgagtcaattaaacctcattataaattatccagtctcaagtatgtctttattaacagcatgagaaatgactaataca

SEQ ID NO: 2722 - DNA, 1236 bp, Artificial Sequence; identical to SEQ ID NO: 980
  Synthetic polypeptide

SEQ ID NO: 2723 - DNA, 523 bp, Artificial Sequence
  Synthetic polypeptide
atgtccacgtggaaagcaagactcaccaaaagactgaagtctccctctagaagcatgcatccatttccgtgctcagctctgctcgcctgttttgggaatacgagggagagtgcttccttcaatcagtccggcgtggctgatactcattccaccgtccgtgtgcagcctgtggccaaagcaggcagacagccaagacacccaagcgcagaaggagctccagagaaaaggcaagattcgagcacccatgcagagagaaatggcagtgcgaatcggaattcaagtcaccgcactgcggcccagcccgcggagacgcctgaagatgtgcccgggtccctggatgatggggcggactgtgaagcagtggtgtttcacgcttccatccccagaccatcaattattgacacgcccaaggaagaagaatttcgagaagaacctaaatgcctcgagctggagcagaaaatgacatcaggtcctgacatattgcctggcccccgttggatgcatggatgtttattgaatgaat

SEQ ID NO: 2724 - DNA, 675 bp, Artificial Sequence
  Synthetic polypeptide
atgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggaagatactggagatgtgttccaccaaaataagcgaataaatcaagaaagagggaaacatgcgattcggaaagcaggagaggaaagaaggtaagccccaggctaacagtcaagcaggaggcctcgagagcagccagaacactaggcaggaagatggaggttgggggatgaggaagaggatgggaactcacagattatctga

SEQ ID NO: 2725 - DNA, 837 bp, Artificial Sequence
  Synthetic polypeptide
atgctgcatctgtcagcagaggaagccattggctgcgtgagggtcagaaggagcttcatagatgagctggcatttgggagagggcattctacagggacgggcaagcagaagcgaagggatcgagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggaagatactggagatgtgttccaccaaaataagcgaataaatcaagaaagagggaaacatgcgattcggaaagcaggagaggaaagaaggtaagccccaggctaacagtcaagcaggaggcctcgagagcagccagaacactaggcaggaagatggaggttgggggatgaggaagaggatgggaactcacagattatctga

SEQ ID NO: 2726 - DNA, 980 bp, Artificial Sequence
  Synthetic polypeptide
atgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaatgctaagctccatgaagacagcaggtc

SEQ ID NO: 2727 - DNA, 1347 bp, Artificial Sequence
  Synthetic polypeptide
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggcactttgggaggccgaggcgggtggatcacctgaggtcaggagttcaagaccagcctgggcaacatggagaaaccctgtctctacaaaaatacaaaaattagccaggtatgatgtcaggtgcctgtaaccccagctactcaggagtctgaggtgggagaattgcttgaacccgggaggcagaggttgcagtgagccgagatcgccccattgcactccagcctgagcaacacagcaagactctgtttcaaaaaaaaaaaaaaaaa

SEQ ID NO: 2728 - DNA, 1113 bp, Artificial Sequence
  Synthetic polypeptide
atgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggcactttgggaggccgaggcgggtggatcacctgaggtcaggagttcaagaccagcctgggcaacatggagaaaccctgtctctacaaaaatacaaaaattagccaggtatgatgtcaggtgcctgtaaccccagctactcaggagtctgaggtgggagaattgcttgaacccgggaggcagaggttgcagtgagccgagatcgccccattgcactccagcctgagcaacacagcaagactctgtttcaaaaaaaaaaaaaaaaa

SEQ ID NO: 2729 - DNA, 322 bp, Artificial Sequence
  Synthetic polypeptide
agtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2730 - DNA, 465 bp, Artificial Sequence
  Synthetic polypeptide
tgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2731 - DNA, 1663 bp, Artificial Sequence
  Synthetic polypeptide
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2732 - DNA, 1429 bp, Artificial Sequence
  Synthetic polypeptide
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggtcgggtcttctaagcagcctcttcccatcaaagctatgctcagatctctacccatttggtccatatgtttaggctgtttcagccatcaatggttagttagcacaatggttgtatacataccaacttacatcagctctgtgtaccatgttaacatcagagacaatggacttctatctgcccttccttttattgttgcctgggtcataggcatggtgggaggctatctggcagatttccttctaaccaaaaagtttagactcatcactgtgaggaaaattgccacaattttaggaagtctcccctcttcagcactcattgtgtctctgccttacctcaattccggctatatcacagcaactgccttgctgacgctctcttgcggattaagcacattgtgtcagtcagggatttatatcaatgtcttagatattgctccaaggtattccagttttctcatgggagcatcaagaggattttcgagcatagcacctgtcattgtacccactgtcagtggatttcttcttagtcaggaaaatggatggtgctggaggccattatcctagaaaactaacgcaggaacagaaaaccaaataccacatgttctcacttataagtagaagacaaaggatgagcattcatggacacaaggaggggaacaacagacactggatcttacttgagagtgaagggtgggaggagggaaagagtcagaaaaaaaaaactattggggactaggcttagtacctgggtgatgaaatatctgtacaacaaactcccattacatgagtttacctatataccacaactgcacatgtgcctctaagcctaaaa

SEQ ID NO: 2733 - DNA, 166 bp, Artificial Sequence
  Synthetic polypeptide
caagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtaatatgt

SEQ ID NO: 2734 - DNA, 370 bp, Artificial Sequence
  Synthetic polypeptide
atggccgcagaccagcgcccgaaggccgacacgctggccctgaggcaacggctcatcagctcttcctgcagactcttttttcccgaggatcctgttaagattgtccgggcccaagggcagtacatgtacgatgaacagggggcagaatacatcgattgcatcagcaatgtggcgcacgttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtaatatgt

SEQ ID NO: 2735 - DNA, 412 bp, Artificial Sequence
  Synthetic polypeptide
atggccgcagaccagcgcccgaaggccgacacgctggccctgaggcaacggctcatcagccaccttttctcaggatccgggagactgacgcggacacatgcagaaatgagcaaggaggccacagaggctgaaaatgctttcagaaacaatccgaagtttcagcgacttgttaccccatctgcttcctgctttgcaaccacctgtggagtggagagacaagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggatcattgctggagcttagtgaggtaatatgt

SEQ ID NO: 2736 - DNA, 351 bp, Artificial Sequence; identical to SEQ ID NO: 917
  Synthetic polypeptide

SEQ ID NO: 2737 - DNA, 211 bp, Artificial Sequence; identical to SEQ ID NO: 912
  Synthetic polypeptide

SEQ ID NO: 2738 - DNA, 2721 bp, Artificial Sequence; identical to SEQ ID NO: 962
  Synthetic polypeptide

SEQ ID NO: 2739 - DNA, 2549 bp, Artificial Sequence; identical to SEQ ID NO: 963
  Synthetic polypeptide

SEQ ID NO: 2740 - DNA, 1624 bp, Artificial Sequence
  Synthetic polypeptide
atgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggatggagttctgaagatggacggtggtgacggttacacagtatgtgaatgtattgatacattatgaactctacacgtaaaaatggctaaaatggtaagttttatgttatgtgtattttaccataat

SEQ ID NO: 2741 - DNA, 313 bp, Artificial Sequence
  Synthetic polypeptide
atggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaatggaggctccatgagaacaaggaatgtgtgttttttcgctaatgcacccatgcctacaactgaccctggcagcgtaagcattcaacagatcattgt

SEQ ID NO: 2742 - DNA, 777 bp, Artificial Sequence
  Synthetic polypeptide
atgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctaccaccgctgggttagggtctccacaaccgagctggtctcggca

SEQ ID NO: 2743 - DNA, 282 bp, Artificial Sequence
  Synthetic polypeptide
atggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctaccaccgctgggttagggtctccacaaccgagctggtctcggca

SEQ ID NO: 2744 - DNA, 490 bp, Artificial Sequence
  Synthetic polypeptide
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggtctcccacgtcttcaccaactttggcaagggcatccgctaccaccgctgggttagggtctccacaaccgagctggtctcggca

SEQ ID NO: 2745 - DNA, 690 bp, Artificial Sequence
  Synthetic polypeptide
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccatcttcacaaaaaataaagaaaaaagaaaa

SEQ ID NO: 2746 - DNA, 690 bp, Artificial Sequence
  Synthetic polypeptide
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccatcttcacaaaaaataaagaaaaaagaaaa

SEQ ID NO: 2747 - DNA, 825 bp, Artificial Sequence
  Synthetic polypeptide
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccatcttcacaaaaaataaagaaaaaagaaaa

SEQ ID NO: 2748 - DNA, 603 bp, Artificial Sequence
  Synthetic polypeptide
atggctgtctcagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacgagtaattctttgcattctggaaatggtcctggttcgaagcccagagttactaaggaggtactccgcaaaagataaatggtaaagatgcattttccttctaaattcaaggttccttgacagttttaactctccacctcccaggcttacttgggacactaatgtatattatgaaagtggctgccatctggctgcctgaagtagactcagaagctggagtcaccaccccttccatcttacagcaggtagaagaggagtcagctcccattctttcttgtcccaacccataaataaagggacagtgatagacttccccttctataggaaccacaaagctgttcataatagaaaaactgggagtcactagaacaagtatttataaatcaatat

SEQ ID NO: 2749 - DNA, 377 bp, Artificial Sequence; identical to SEQ ID NO: 2235
  Synthetic polypeptide

SEQ ID NO: 2750 - DNA, 347 bp, Artificial Sequence; identical to SEQ ID NO: 2236
  Synthetic polypeptide

SEQ ID NO: 2751 - DNA, 4408 bp, Artificial Sequence
  Synthetic polypeptide
atgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgttttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacgaatcaaggccatcaggctacagatggtcttacaaatggaaccccaaatgagctcaactaacaacttctatcaaggacccctggaccgacccactggccctttcattagcctaaagagttcccctctggaggacactacaacttcagggccccttctttgcccctatccagcgggaagtagctagagtggtcatcacccaattcccagcagcagttggggtgtcctgtttagaggggggat

SEQ ID NO: 2752 - DNA, 582 bp, Artificial Sequence
  Synthetic polypeptide
gggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2753 - DNA, 511 bp, Artificial Sequence
  Synthetic polypeptide
atggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2754 - DNA, 719 bp, Artificial Sequence
  Synthetic polypeptide
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2755 - DNA, 1006 bp, Artificial Sequence
  Synthetic polypeptide
atgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacagtaaaagccaaagttatgcagccacggaaaagaaatgaagcatgaattcacactgcaacgtggataaactgaaaacatgatgctgaaagaggccagacatgaaatgacaaatactgtatgattccacatatatgaaatgtacactaagaagattggcgactgccaggggctgggggagggaggtcttggaaatgacagctcatggatgcagagttttttcctggggtgatgggaattaggtagtggtgatggctgcataatatcgtgaatcaactaaaaaccactgaattgtacactttaaaaaatgaattttg

SEQ ID NO: 2756 - DNA, 3308 bp, Artificial Sequence; identical to SEQ ID NO: 428
  Synthetic polypeptide

SEQ ID NO: 2757 - DNA, 3203 bp, Artificial Sequence; identical to SEQ ID NO: 429
  Synthetic polypeptide

SEQ ID NO: 2758 - DNA, 2849 bp, Artificial Sequence; identical to SEQ ID NO: 430
  Synthetic polypeptide

SEQ ID NO: 2759 - DNA, 388 bp, Artificial Sequence; identical to SEQ ID NO: 431
  Synthetic polypeptide

SEQ ID NO: 2760 - DNA, 499 bp, Artificial Sequence; identical to SEQ ID NO: 2210
  Synthetic polypeptide

SEQ ID NO: 2761 - DNA, 331 bp, Artificial Sequence
  Synthetic polypeptide
atgttccaggtcccggatagcgagggcggccgcgccggctccagggtgcagtgactcaacggctgtaatcccggcacttggggaggccgaggcaggtggaccacgagatcaggagatcgagaccatcctggccaacacggtgaaaccccgtctctactaaaaatacgaaaaaattagccgggtgtggggtggcgggtgcctgtagtcccagttccttgagaggctgaggcaggagaatggtgtgaacccgggaggcggagcttgcagtgagccgagatcacaccactgcactccagcctggatgacagagcaagactccgtctcaaagaaa

SEQ ID NO: 2762 - DNA, 1284 bp, Artificial Sequence; identical to SEQ ID NO: 2536
  Synthetic polypeptide

SEQ ID NO: 2763 - DNA, 892 bp, Artificial Sequence
  Synthetic polypeptide
atggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccagttacccacagtgttcaccacagtaacatgctgtacagaaacccaggagaaataggctataccctatagcctaggtgtgtagcaggctctaccatctaagtatgtgtaagtacactctgatgttaatacaacgaaatcggctaatgataaatttcttagaatgtgtatccctgttgataagcaatgtatga

SEQ ID NO: 2764 - DNA, 2161 bp, Artificial Sequence; identical to SEQ ID NO: 288
  Synthetic polypeptide

SEQ ID NO: 2765 - DNA, 2140 bp, Artificial Sequence; identical to SEQ ID NO: 289
  Synthetic polypeptide

SEQ ID NO: 2766 - DNA, 529 bp, Artificial Sequence; identical to SEQ ID NO: 287
  Synthetic polypeptide

SEQ ID NO: 2767 - DNA, 2117 bp, Artificial Sequence
  Synthetic polypeptide
atggatagagcagcgctgcgcgcggcggcgatgggagagaagaaggagggcggtggcgggggggatgcggcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2768 - DNA, 2183 bp, Artificial Sequence
  Synthetic polypeptide
atggatagagcagcgctgcgcgcggcggcgatgggagagaagaaggagggcggtggcgggggggatgcggcggccgcggagggaggcgcaggggccgcggccagccgggcgctgcagcagtgcgggcagctccagaagctcatcgacatctccatcggcagcctgcgcgggctgcgcaccaagtgcgctgtgtccaacgacctcacccagcaggagatacggaccctggaggcgaagctggtccgttacatttgtaagcagaggcagtgcaagctgagcgtggctcccggtgagaggaccccagagctcaacagctacccccgcttcagcgactggctgtacactttcaacgtgaggccggaggtggtgcaggagatcccccgagacctcacgctggatgccctgctggagatgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2769 - DNA, 1772 bp, Artificial Sequence
  Synthetic polypeptide
atgaatgaggccaaggtgaaggagacgctgcggcgctgtggggccagcggggatgagtgtggccgtctgcagtatgccctcacctgcctgcggaaggtgacaggcctgggaggggagcacaaggaggactccagttggagttcattggatgcgcggcgggaaagtggctcagggccttccacggacaccctctcagcagccagcctgccctggcccccagggagctcccagctgggcagagcaggcaacagcgcccagggcccacgctccatctccgtgtcagctctgcccgcctcagactcccccacccccagcttcagtgagggcctctcagacacctgtattcccctgcacgccagcggccggctgaccccccgtgccctgcacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagtgccatctgctggccattgctggaaatgcctccttattgcagaaagtttaaaggaaaacgctttcaacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2770 - DNA, 1322 bp, Artificial Sequence
  Synthetic polypeptide
cacagcttcatcaccccgcccaccacaccccagctgcgacggcacaccaagctgaagccaccacggacgccccccccacccagccgcaaggtcttccagctgctgcccagcttccccacactcacccggagcaagtcccatgagtctcagctggggaaccgcattgatgacgtctcctcgatgaggtttgatctctcgcatggatccccacagatggtacggagggatatcgggctgtcggtgacgcacaggttctccaccaagtcctggctgtcgcaggtctgccacgtgtgccagaagagcatgatatttggagtgaagtgcaagcattgcaggttgaagtgtcacaacaaatgtaccaaagaagcccctgcctgtagaatatccttcctgccactaactcggcttcggaggacagaatctgtcccctcggacatcaacaacccggtggacagagcagccgaaccccattttggaaccctccccaaagcactgacaaagaaggagcaccctccggccatgaatcacctggactccagcagcaacccttcctccaccacctcctccacaccctcctcaccggcgcccttcccgacatcatccaacccatccagcgccaccacgccccccaacccctcacctggccagcgggacagcaggttcaacttcccagctgcctacttcattcatcatagacagcagtttatctttccagacatttcagcctttgcacacgcagccccgctccctgaagctgccgacggtacccggctcgatgaccagccgaaagcagatgtgttggaagctcacgaagcggaggctgaggagccagaggctggcaagtcagaggcagaagacgatgaggacgaggtggacgacttgccgagctctcgccggccctggcggggccccatctctcgcaaggccagccagaccagcgtgtacctgcaggagtgggacatccccttcgagcaggtagagctgggcgagcccatcgggcagggccgctggggccgggtgcaccgcggccgctggcatggcgaggtggccattcgcctgctggagatggacggccacaaccaggaccacctgaagctcttcaagaaagaggtgatgaactaccggcagacgcggcatgagaacgtggtgctcttcatgggggcctgcatgaacccgccccacctggccattatcaccagcttctgcaaggggcggacgttgcactcgtttgtgagggaccccaagacgtctctggacatcaacaagacgaggcaaatcgctcaggagatcatcaaggtaaatcatccagcccagggtggcac

SEQ ID NO: 2771 - DNA, 739 bp, Artificial Sequence
  Synthetic polypeptide
atgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctga

SEQ ID NO: 2772 - DNA, 988 bp, Artificial Sequence
  Synthetic polypeptide
atggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctga

SEQ ID NO: 2773 - DNA, 907 bp, Artificial Sequence
  Synthetic polypeptide
atggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctga

SEQ ID NO: 2774 - DNA, 384 bp, Artificial Sequence; identical to SEQ ID NO: 968
  Synthetic polypeptide

SEQ ID NO: 2775 - DNA, 429 bp, Artificial Sequence
  Synthetic polypeptide
gcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgccctcaaccctgaagtctcttccagctcttaaaatct

SEQ ID NO: 2776 - DNA, 373 bp, Artificial Sequence
  Synthetic polypeptide
atggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgccctcaaccctgaagtctcttccagctcttaaaatct

SEQ ID NO: 2777 - DNA, 487 bp, Artificial Sequence
  Synthetic polypeptide
atgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacaggttgccctcaaccctgaagtctcttccagctcttaaaatct

SEQ ID NO: 2778 - DNA, 1218 bp, Artificial Sequence
  Synthetic polypeptide
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2779 - DNA, 1326 bp, Artificial Sequence
  Synthetic polypeptide
atggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2780 - DNA, 1236 bp, Artificial Sequence
  Synthetic polypeptide
atgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2781 - DNA, 423 bp, Artificial Sequence
  Synthetic polypeptide
gcattagtatccgctgcaaagcttgaaaaagaagcagtgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2782 - DNA, 338 bp, Artificial Sequence
  Synthetic polypeptide
aaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggagaagtctggcctaggaggtggaggatgcagcgcaccaagatcgcaccactgtactccaggatgggcaccagagtgagaccttgtctcaaaaaaaaaaaaaaaaaaaaaa

SEQ ID NO: 2783 - DNA, 382 bp, Artificial Sequence
  Synthetic polypeptide
atggcggtcaatgtgtattctacctcgataacccaagagactatgagcagacatgacatcattgcatgggttaatgacatagtatctttaaactacacaaaagtggaacagctttgttcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccata

SEQ ID NO: 2784 - DNA, 475 bp, Artificial Sequence
  Synthetic polypeptide
atgaaacagaacagagatcaaaagtgtcctgtttcccagaggaacagttcatttcaacagccagggagaaagcctggatgctcaagttggggaatggcggtcaatgtgtattctacctcgataacccaagagactatgagcagacatgacatcattgcatgggttaatgacatagtatctttaaactacacaaaagtggaacagctttgttcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccata

SEQ ID NO: 2785 - DNA, 511 bp, Artificial Sequence
  Synthetic polypeptide
atgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcatgggttaatgacatagtatctttaaactacacaaaagtggaacagctttgttcaggatacaaaatcagcgtaacaaaagtcagcagcgtttctgtatgctgataccaaactatctgaaaaattaaggaagcaatcccacttataatcactaccaaaaaaatgagacacctaagaataaacttagcgaaggagctgaaagatttctacaatggaaacatataaaacattgatgaaagaaattgaagaggacataaataaatggaaagccatgccatgtttatggattggaaaaatcaatattgttaaaaagtccata

SEQ ID NO: 2786 - DNA, 4292 bp, Artificial Sequence
  Synthetic polypeptide
accaaatctactccaaagatccccaaaactgtcaggaattccttggatcaccagaactcatcaactggaaacagcatttacagattcaaagcctaccctaaaagagctcctgaaggaagcactaaacatggaaaggaacaaccggtaccagccactgcaaaatcatgccaaaatataaagaccatcgagactaggaagaaactgcatcaactaacgagcaaaataaccagctaacatcataacggcaggatcaaattcacacagaacaatattaactttaaatgtaaatggactaaatgctccaattaaaagacacagactggcaaattggataaaaagtcaagtcccatcagtgtgctgtattcaggaaacccatctcacgtgcagagacacacataggctcaaaataaaaggatggaggaagatctaccaagcaaatggaaaacaaaaaaaggcaggggttgaaatcccagtctctgacaaaacagactttaaaccaacaaagataaaaagagataaagaaggccattacataatggtaaagggatcaattcacaagaagagctaactatcctaaatatatatgcaaccaatacaggagcacccagattcataaagcaagtcctgagtgacctacaaagagacttagactcccacacaataataatgggagactttaacacaaccactgtcaacattaggcagatccacgagacagaaagttaacaaggatacccaggaattcaactcagctctgcaccaagcagacctaatagacatctacagaactctccacctcagatcagcagaatatacattttttcaacaccacaccacacctattccaaaattgaccacataattggaagtaaagctcgcctcagcaaatgtaaaagaacagaaattataacaaactatctctcagaccacagtgcaatcaaactagaactcaggattaagaaactcactcaaaactgctcaactacacagaaactgaacaacctgctcctgaatgactaccgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaaggaataactaaaatcagagcagaactgaaggagatagagacacaaaaaactcttcaaaaaattaatgaatccaggagctggttttttgaaaggttcaacaaaattgatagaccgctagcaagactaataaagaaacaaggagagaagaatcaaagagacgcaataaaaaatgataaagggggtatcaccaccaatcccacagaaatacaaactaccatcagagaatactacaaacacctctacgcaaataaactagaaaatctagaagaaatggataaattcctcgacacgtacaccctcccaagactaaaccaggaagaagttgattctctgaattgaccaataacaggctctgaaattgtgccaataatcaatagcttaccaaccaaaaagagtccaggaccagatggattcacagccgaattctactagaggtacaaggaggaactggtaccattccttctgaaactattccaatcaatagaaaaagagggaatcctccctaactcattttgtgaggccagcatcatcccgataccaaagcctggcagagacacaaccaaaaaagagaattttagaccaatatctttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaaccacatggttatctcaatagatgcagaaaaggctttgacaaaattcaacaatgcttcatgctaaaaactctcaataaattaggtattgatgggatgtatctcaaaataataagagctatctatgacaaacccacatccaatatcatactgaatgggcaaaaactggaagcattccctttgaaaactggcacaagacagggatgccctctctcaccactcctattcaacttagtgttggaagttctggccagggcaattaggcaggagaaggaaataatgggtattcaattaggaaaagaggaagtcaaattgtccctgtttacagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacttgaaggacttcttcaaggagaactaccaaccaccgctcaaggaaataaaagaggatacaaaaaatggaagaacattccatgctcatgggtaggaagaatcaatatcgtgaaaatggccatactgcccaaggtaatttatagattcaatgccatccccatcaagctaccaatgactttcttaacagaattggaaaaaactacttgaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgatgcatatctacaactatctgatctttgacaaacctgagaaaaacaagcaatggggaaaggattccctatttaataaatggtgctgggaaaactggctagccagatgtagaaagctgaaactggatcccttccttacaccttatacaaaaattaattcaagatggattaaagacttaaacgttagacctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccacatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaaaaaaaaaggtgctcaggtgcaggagaggatgtggagaaataggaacacgtttacactgttggtgggactgtaaactagttcaaccattgtggaagtcagtgtggcgattcctcaaggatctagaactagatataccatttgacccagccatcccattactgggtatatatccaaaggactataaatcatgctgctataaagacacatgcacacgtatgtttattgcagcactattcacaatagcaaagacttggaactaacccacatgtccaacaatgatagactggattaagaaaacgtggcacatatacaccatggaatactatgcagccataaaaaatggtgagttcatgtcctttgtagggacatggatgaaattggaaatcatcattctcagtaaactatcgcaaggacaaaaaaccaaacaccgcatgttctcactcataggtgggaattgaactatgagaacacatggacacaggaaggggaacatcacactctggggacagttgtggggtggggggaggggggagggatagcattaggagatatacctaatgctaaatgacgagttaaggggtgcagcacaccagcatggcacatgtatacataggtaactaacctgcacattgtgcacatgtaccctaaaacttaaagtataataataataaaa

SEQ ID NO: 2787 - DNA, 4518 bp, Artificial Sequence
  Synthetic polypeptide
atgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagcctaccctaaaagagctcctgaaggaagcactaaacatggaaaggaacaaccggtaccagccactgcaaaatcatgccaaaatataaagaccatcgagactaggaagaaactgcatcaactaacgagcaaaataaccagctaacatcataacggcaggatcaaattcacacagaacaatattaactttaaatgtaaatggactaaatgctccaattaaaagacacagactggcaaattggataaaaagtcaagtcccatcagtgtgctgtattcaggaaacccatctcacgtgcagagacacacataggctcaaaataaaaggatggaggaagatctaccaagcaaatggaaaacaaaaaaaggcaggggttgaaatcccagtctctgacaaaacagactttaaaccaacaaagataaaaagagataaagaaggccattacataatggtaaagggatcaattcacaagaagagctaactatcctaaatatatatgcaaccaatacaggagcacccagattcataaagcaagtcctgagtgacctacaaagagacttagactcccacacaataataatgggagactttaacacaaccactgtcaacattaggcagatccacgagacagaaagttaacaaggatacccaggaattcaactcagctctgcaccaagcagacctaatagacatctacagaactctccacctcagatcagcagaatatacattttttcaacaccacaccacacctattccaaaattgaccacataattggaagtaaagctcgcctcagcaaatgtaaaagaacagaaattataacaaactatctctcagaccacagtgcaatcaaactagaactcaggattaagaaactcactcaaaactgctcaactacacagaaactgaacaacctgctcctgaatgactaccgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaaggaataactaaaatcagagcagaactgaaggagatagagacacaaaaaactcttcaaaaaattaatgaatccaggagctggttttttgaaaggttcaacaaaattgatagaccgctagcaagactaataaagaaacaaggagagaagaatcaaagagacgcaataaaaaatgataaagggggtatcaccaccaatcccacagaaatacaaactaccatcagagaatactacaaacacctctacgcaaataaactagaaaatctagaagaaatggataaattcctcgacacgtacaccctcccaagactaaaccaggaagaagttgattctctgaattgaccaataacaggctctgaaattgtgccaataatcaatagcttaccaaccaaaaagagtccaggaccagatggattcacagccgaattctactagaggtacaaggaggaactggtaccattccttctgaaactattccaatcaatagaaaaagagggaatcctccctaactcattttgtgaggccagcatcatcccgataccaaagcctggcagagacacaaccaaaaaagagaattttagaccaatatctttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaaccacatggttatctcaatagatgcagaaaaggctttgacaaaattcaacaatgcttcatgctaaaaactctcaataaattaggtattgatgggatgtatctcaaaataataagagctatctatgacaaacccacatccaatatcatactgaatgggcaaaaactggaagcattccctttgaaaactggcacaagacagggatgccctctctcaccactcctattcaacttagtgttggaagttctggccagggcaattaggcaggagaaggaaataatgggtattcaattaggaaaagaggaagtcaaattgtccctgtttacagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacttgaaggacttcttcaaggagaactaccaaccaccgctcaaggaaataaaagaggatacaaaaaatggaagaacattccatgctcatgggtaggaagaatcaatatcgtgaaaatggccatactgcccaaggtaatttatagattcaatgccatccccatcaagctaccaatgactttcttaacagaattggaaaaaactacttgaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgatgcatatctacaactatctgatctttgacaaacctgagaaaaacaagcaatggggaaaggattccctatttaataaatggtgctgggaaaactggctagccagatgtagaaagctgaaactggatcccttccttacaccttatacaaaaattaattcaagatggattaaagacttaaacgttagacctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccacatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaaaaaaaaaggtgctcaggtgcaggagaggatgtggagaaataggaacacgtttacactgttggtgggactgtaaactagttcaaccattgtggaagtcagtgtggcgattcctcaaggatctagaactagatataccatttgacccagccatcccattactgggtatatatccaaaggactataaatcatgctgctataaagacacatgcacacgtatgtttattgcagcactattcacaatagcaaagacttggaactaacccacatgtccaacaatgatagactggattaagaaaacgtggcacatatacaccatggaatactatgcagccataaaaaatggtgagttcatgtcctttgtagggacatggatgaaattggaaatcatcattctcagtaaactatcgcaaggacaaaaaaccaaacaccgcatgttctcactcataggtgggaattgaactatgagaacacatggacacaggaaggggaacatcacactctggggacagttgtggggtggggggaggggggagggatagcattaggagatatacctaatgctaaatgacgagttaaggggtgcagcacaccagcatggcacatgtatacataggtaactaacctgcacattgtgcacatgtaccctaaaacttaaagtataataataataaaa

SEQ ID NO: 2788 - DNA, 809 bp, Artificial Sequence; identical to SEQ ID NO: 2110
  Synthetic polypeptide

SEQ ID NO: 2789 - DNA, 644 bp, Artificial Sequence; identical to SEQ ID NO: 2111
  Synthetic polypeptide

SEQ ID NO: 2790 - DNA, 768 bp, Artificial Sequence; identical to SEQ ID NO: 2112
  Synthetic polypeptide

SEQ ID NO: 2791 - DNA, 427 bp, Artificial Sequence; identical to SEQ ID NO: 2113
  Synthetic polypeptide

SEQ ID NO: 2792 - DNA, 3220 bp, Artificial Sequence; identical to SEQ ID NO: 248
  Synthetic polypeptide

SEQ ID NO: 2793 - DNA, 1018 bp, Artificial Sequence; identical to SEQ ID NO: 1345
  Synthetic polypeptide

SEQ ID NO: 2794 - DNA, 925 bp, Artificial Sequence; identical to SEQ ID NO: 1346
  Synthetic polypeptide

SEQ ID NO: 2795 - DNA, 736 bp, Artificial Sequence; identical to SEQ ID NO: 1347
  Synthetic polypeptide

SEQ ID NO: 2796 - DNA, 1675 bp, Artificial Sequence
  Synthetic polypeptide
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccttggaatgcagatgggaaggtgagcaagcttggaccatgaagacaaaggcaacacccgagagatggagcagcttcaagttgaagggagcctgag

SEQ ID NO: 2797 - DNA, 558 bp, Artificial Sequence
  Synthetic polypeptide
atggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaaggaagaa

SEQ ID NO: 2798 - DNA, 3265 bp, Artificial Sequence
  Synthetic polypeptide
atgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2799 - DNA, 3160 bp, Artificial Sequence
  Synthetic polypeptide
atggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2800 - DNA, 2806 bp, Artificial Sequence
  Synthetic polypeptide
atggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2801 - DNA, 345 bp, Artificial Sequence
  Synthetic polypeptide
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagctttct

SEQ ID NO: 2802 - DNA, 1399 bp, Artificial Sequence
  Synthetic polypeptide
atgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2803 - DNA, 2419 bp, Artificial Sequence
  Synthetic polypeptide
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2804 - DNA, 2356 bp, Artificial Sequence
  Synthetic polypeptide
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2805 - DNA, 2254 bp, Artificial Sequence
  Synthetic polypeptide
atgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagacaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2806 - DNA, 1395 bp, Artificial Sequence
  Synthetic polypeptide
atgctagagaaccatattttacataaaagaatatatatattaacatttttcagtcagcagatatttattttatgtcatgcccatttcattttctttttcactgttagggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2807 - DNA, 2415 bp, Artificial Sequence
  Synthetic polypeptide
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2808 - DNA, 2352 bp, Artificial Sequence
  Synthetic polypeptide
atggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2809 - DNA, 2250 bp, Artificial Sequence
  Synthetic polypeptide
atgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacagaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaagggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcaggcaataacaaatgcttgagaggatgtggagaaaagggacccctccacattgggaccactgctgttgagaatgtaattaattacaaccactatggagtacagtttggaggttcctcaaaaaaactaaaaatggagctgccatatgatacagcaattccagtgcttgatatatacccagaagaaaaagaaatcagtgtgccgaagcaatatctgcactcctgtgtttgttgcagcactgttcacaataggtaagatttggagacagcctaaatgtccatccacagatgtatggata

SEQ ID NO: 2810 - DNA, 1649 bp, Artificial Sequence
  Synthetic polypeptide
atgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattgccccacctccgacactggggattacgactcaacatgagatctggcggggacaaatgtccaaaccatcccagtctccctcacgttctcccagcggacattggcgagccgctgcccagcgtcaggtgctgggcactgagatgtgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2811 - DNA, 1508 bp, Artificial Sequence
  Synthetic polypeptide
atgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2812 - DNA, 782 bp, Artificial Sequence
  Synthetic polypeptide
ctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2813 - DNA, 1504 bp, Artificial Sequence
  Synthetic polypeptide
atgggggaggcgcccagccccgcgcccgcgctctgggactgggactacctggaccgctgcttcgcccgccaccgcgtctgcatctccttcggcctgtggatctgcgcctcctcctgctggatcgccgcccacgcgctgcttctctatctgagatgtgcacagaaacccagacaggaccagtcggcactgtgtgctgcgtgctgcctcctgaccagtctgtgtgacaccgtcggggctcttctggccagacagctcacaatccaggttttcactggtgcctacctagcagctattgacttagtgaactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaatttgccgggggaagacatttccctccatccacctgtggacccggctcctgtcggccctggctggcctcctctatgcctcggccattgtggcccacgaccagcaccctgagtacctgctgcgggccacaccctggttcctgacctccctcggccgtgcggcactggacctcgctattattttcctttcgtgtgtgatgaagagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2814 - DNA, 1007 bp, Artificial Sequence
  Synthetic polypeptide
aactttatgttcattctcttcccagtctgtggatccaaattcaagtctaattcagatcgggaagcccgagagaggaagaggaggcggcagctcagggccagtgtgtttgccctggccctgccgctgagcctgggcccgtgctgggctctgtgggttgctgtcccgaaggcttcagccaccatccgggggccacagcggaggctgctagcgagcctgctgcaggaaaatactgagatcctcggctacctgctgggtagcgttgctgcctttggctcctgggcttctcggatcccccctctctccagaattagcaagatgagacaggccttaggatttgccaaggaagccagagagagccctgacacccaagcccttttgacctgtgcagagaaagaggaagaaaaccaggagaatttggattgggtgcctctcaccacactgtcacactgcaagtcactgaggacaatgacagcaatcagtcgctacatggagctgaccatcgagcctgtgcagcaggcaggctgcagtgccaccaggctgccaggtgacgggcagacgagcgccggagatgcgtccctgcaggaccccccgtcgtaccctcccgttcaggtcatccgggcccgggtgtcttccggcagctcctctgaggtctcctccatcaactccgacctggagactccacacttgatggatcagctggcaccacccagatggataaactggctcatctgatcttgtggccccgacccaggaactgactcagcgcaagaagacagctgactccctgtgatatcatccctgatcaatcagcactcccggctcactggctctccacacccaccaagctgtccttaaaaactctgctccccgaatgctcggggagactgatttgagtaataatacagcttcggtctcccacacggccggctctgcatggattactctttctctactgcagttcccctgtcttgataaataggctgtgtctaggcagcgggcaaggtgaa

SEQ ID NO: 2815 - DNA, 2226 bp, Artificial Sequence
  Synthetic polypeptide
atggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2816 - DNA, 2202 bp, Artificial Sequence
  Synthetic polypeptide
atgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2817 - DNA, 480 bp, Artificial Sequence
  Synthetic polypeptide
atgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2818 - DNA, 284 bp, Artificial Sequence
  Synthetic polypeptide
acttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgag

SEQ ID NO: 2819 - DNA, 535 bp, Artificial Sequence
  Synthetic polypeptide
atggccttctcaggccgagcgcgcccctgcattatcccagagaacgaagaaatcccccgagcagcccttaacactgtccacgaggccaatgggaccgaggacgagagggctgtttccaaactgcagcgcaggcacagtgacgtgaaagtctacaaggagttctgtgacttttatgcgaaattcaacatggccaacgccctggccagcgccacttgcgagcgctgcaagggcggctttgcgcccgctgagacgatcgtgaacagtaatggggagctgtaccatgagcagtgtttcgtgtgcgctcagtgcttccagcagttcccagaaggactcttctatgagtttgaaggaagaaagtactgtgaacatgactttcagatgctctttgccccttgctgtcatcagtgtggtgccagtaatcccagttattcaagaggctgaggcaggagaatcgcttgaacccagggggcagaggttgcagtgagctgagattgcaccacttcactccagcctgggcaacagccaaactccatct

SEQ ID NO: 2820 - DNA, 1079 bp, Artificial Sequence
  Synthetic polypeptide
atggcttgtaccatccaaaaggcagaagcacttgacggggctcatttgatgcagatcctctggtatgatgaggaagagtctctctacccagctgtatggttgagagacaactgtccgtgctctgattgctacctggattccgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccagctgtctggaataccctgctctacaaccctttatgcctggaaaactccccttcttccttcaaagttcagcctaagat

SEQ ID NO: 2821 - DNA, 2151 bp, Artificial Sequence; identical to SEQ ID NO: 127
  Synthetic polypeptide

SEQ ID NO: 2822 - DNA, 1833 bp, Artificial Sequence; identical to SEQ ID NO: 126
  Synthetic polypeptide

SEQ ID NO: 2823 - DNA, 3536 bp, Artificial Sequence
  Synthetic polypeptide
atgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2824 - DNA, 3431 bp, Artificial Sequence
  Synthetic polypeptide
atggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2825 - DNA, 3077 bp, Artificial Sequence
  Synthetic polypeptide
atggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2826 - DNA, 616 bp, Artificial Sequence
  Synthetic polypeptide
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagggcgcggtggctcacacctgtaatctcagcaccttgggaggctgaagcaggcagatcacttaaggccagaagttcaagaccagcctgggcaaaatggagaaaccccatctcgactaaaaaatacaaaaattagccgggcatggtggtgcatgcctgtaatcccagctactcaggaggctgaggcagagaatttcttgaacccagaagatggaggttgcagtgagccaaaattgcaccactgcactccagcctgggtgagagagcaagactctgtctc

SEQ ID NO: 2827 - DNA, 1606 bp, Artificial Sequence; identical to SEQ ID NO: 327
  Synthetic polypeptide

SEQ ID NO: 2828 - DNA, 175 bp, Artificial Sequence; identical to SEQ ID NO: 329
  Synthetic polypeptide

SEQ ID NO: 2829 - DNA, 2108 bp, Artificial Sequence
  Synthetic polypeptide
atgcaacagaaggcttttgaggaaagcagatatccctggcaggagtcctttgagaatgttgctgtgtgcctgccattacgctgcccgaggtgtggagaccataccagatttagaagcttgtcatccttgagggcccatctggagttcagtcacagctacgaagaaagaaccctcttgacaaaatgcagtctctttccatccctcaaagacacagacctagtcacttcctcagaactcctgaaaccgggaaaattgcagagcagtggcaacgtggtaaagcagaaaccgagctatgttaacttgtacagcatttcacatgaacattccaaggacaggaagccatttgaggtggtggcagagaggcctgtgtcctatgtgcagacctacactgccatggacctccatgcagactcgctggatgggacacggtcgggtcctggactgcccacctcagacaccaaagcttctttcgaggcacatgtcagagaaaaattcaatcgaatggttgaggctgtggataggaccattgagaagagaattgataaactcaccaaagagttggcccagaaaactgcggaactgttggaagttcgggcagcttttgtgcagctgactcagaaaaagcaggaagttcagagacgagagcgggccttaaacagacaggtggacgtggccgtggaaatgatagctgtactgaggcaacgcctgacggaatctgaggaggagcttcttaggaaagaagaagaagttgtcacattcaaccatttcctggaagcggcagctgagaaggaggttcaagggaaagcccggctccaggactttattgagaatctgttacagcgggtagaactggcggagaagcagcttgagtactatcagagccagcaggcctctggctttgtccgtgatctcagcgggcacgtgagctggaaaggtgctggcgaagctcgcctggtgtgccaaaatgacctggaattggagatttttggccatataaaccaccatctttcggggttgaaagattctcattgtctagtttttctgcaagccccacctgtgccctggatcattttagccagctttctctggattctcggaaatccctggacgtcttccacggctactgcaggatttagccaaatttgggtgctatttcccttttgtggagggacttttcatcacaatgagaaggacgtcttaggactccaggactttgagaggcttgcccatggctgagcatgaaccaatcagcacacacttccctgcttctgagcccattaaaacgctggactcagccagactcagacagaagtcaggactaacagctgtgggaaggagctacccacttccggtatccttgactcttcaggattacctgcctgcaggtacgagctacccaccatgggtctcctctccactgagagctggacacttgccaggacgacctgtctgtggaaaggagttacccactttgtgtctcctgagagctcctctgttactcagtgaagctcctctccaccttgctcgccctccagttgtccaggcattccattcttcctggacgcaagacaaaaacttgggacctgccaaatggtggggctgaaggagctataatacaaacaggggtaaaacacaaaccccgctctccataatgagagaagagctgtgacccttcaaggagttcagacctgggggctccccaggccagcgttgtgacaccttctttagggctctgtggttcctggtgtctccaagcttctgggcaccactgcgtttctcagtgcccacaatggaagccgcttgtagtacgcctggtccaccatcagccacggacagagccagcacctggagctggcctccccactgcagccagcatgcctggctgtgtgcagtggccagaaacccttcacactcacacatccctcgccactctgcacatggctcacccttgacaggcatggaatctggccagtagctagagctgaatgcagcctgctgggtcaagtgggtggaatgagcccagcggtcccgaggaaaacttgggcaaaggttccactggccacagaggtttccagctggcagagtgacaccctaaagatcctgtgaca

SEQ ID NO: 2830 - DNA, 1370 bp, Artificial Sequence
  Synthetic polypeptide
atgtctgcgctgggtcagataaccatcactgtctccaggtgctggaatacagagaggaaccaaacagataaaaatccttgcctgcacggagcttaccttcagctaagggagacagtcaaaaacaagtcaacacatctaaagaagccactgatgaaacaggctcccccttggaaagaccatctcaccttccaacctctccatcctgcagagaggaaaacccaagtttggcgttggcagtcaggtaattcatcagatctggaaaccacctcatcagcatccccctggccaactggaagcaaccgtgacgttgtgctgaatacacttgcagagtcgtgctgtggtctctccgagctcatcacggcacctccctatgcaggagtttcaattcaaggatttagccaaatttgggtgctatttcccttttgtggagggacttttcatcacaatgagaaggacgtcttaggactccaggactttgagaggcttgcccatggctgagcatgaaccaatcagcacacacttccctgcttctgagcccattaaaacgctggactcagccagactcagacagaagtcaggactaacagctgtgggaaggagctacccacttccggtatccttgactcttcaggattacctgcctgcaggtacgagctacccaccatgggtctcctctccactgagagctggacacttgccaggacgacctgtctgtggaaaggagttacccactttgtgtctcctgagagctcctctgttactcagtgaagctcctctccaccttgctcgccctccagttgtccaggcattccattcttcctggacgcaagacaaaaacttgggacctgccaaatggtggggctgaaggagctataatacaaacaggggtaaaacacaaaccccgctctccataatgagagaagagctgtgacccttcaaggagttcagacctgggggctccccaggccagcgttgtgacaccttctttagggctctgtggttcctggtgtctccaagcttctgggcaccactgcgtttctcagtgcccacaatggaagccgcttgtagtacgcctggtccaccatcagccacggacagagccagcacctggagctggcctccccactgcagccagcatgcctggctgtgtgcagtggccagaaacccttcacactcacacatccctcgccactctgcacatggctcacccttgacaggcatggaatctggccagtagctagagctgaatgcagcctgctgggtcaagtgggtggaatgagcccagcggtcccgaggaaaacttgggcaaaggttccactggccacagaggtttccagctggcagagtgacaccctaaagatcctgtgaca

SEQ ID NO: 2831 - DNA, 1723 bp, Artificial Sequence
  Synthetic polypeptide
atgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaa

SEQ ID NO: 2832 - DNA, 1276 bp, Artificial Sequence
  Synthetic polypeptide
atgaggcatccaccactcatcactgtgtggagactggaagccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaa

SEQ ID NO: 2833 - DNA, 1960 bp, Artificial Sequence
  Synthetic polypeptide
atgcattggctgcgaaaagttcagggactttgcaccctgtggggtactcagatgtccagccgcactctctacattaatagtaggcaactggtgtccctgcagtggggccaccaggaagtgccggccaagtttaactttgctagtgatgtgttggatcactgggctgacatggagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattaacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggacaatcccgacaagacagcagccaacattcgaggagacttttggctccttggagaccggggaatcaaagatgaagatgggtatttccagtttatgggacgggcaaatgatatcattaactccagcgggtaccggattggaccctcggaggtagagaatgcactgatggagcaccctgctgtggttgagacggctgtgatcagcagcccagaccccgtccgaggagagcaacatggagagaactggaggtcattatgttaactgaagtaagccaggcacagaaaataaatatcacgtgtttgcactcatgagtaagtgctaaaatagctgatctcatggagataaagagtagagtgatagataccagaggctgggaagggtgtgtgggtggggaagtgggggatgaagggaggttggtgaatgggtagaagcatacagttagcagcaataagttcgaatgttcaatagcagagtagggtgactatagttaacaaccatgtattgtatatttcaaaatagctagaagagaggacttgaaatgttctcaacacacacaaattataaatactcaaggtgatggacaccccaagtatcctaacttgataattaccatatttgcgtgtaacaaaatgtcacttgtacccaatacatatgtacaaatattatgaaatgataaaaa

SEQ ID NO: 2834 - DNA, 965 bp, Artificial Sequence; identical to SEQ ID NO: 1035
  Synthetic polypeptide

SEQ ID NO: 2835 - DNA, 725 bp, Artificial Sequence; identical to SEQ ID NO: 1036
  Synthetic polypeptide

SEQ ID NO: 2836 - DNA, 1060 bp, Artificial Sequence
  Synthetic polypeptide
atggacagctcccgggaaccgactctggggcgcttggacgccgctggcttctggcaggtctggcagcgctttgatgcggatgaaaaaggttacatagaagagaaggaactcgatgctttctttctccacatgttgatgaaactgggtactgatgacacggtcatgaaagcaaatttgcacaaggtgaaacagcagtttatgactacccaagatgcctctaaagatggtcgcattcggatgaaagagcttgctggtatgttcttatctgaggatgaaaactttcttctgctctttcgccgggaaaacccactggacagcagcgtggagtttatgcagatttggcgcaaatatgacgctgacagcagtggctttatatcagctgctgagctccgcaacttcctccgagacctctttcttcaccacaaaaaggccatttctgaggctaaactggaagaatacactggcaccatgatgaagatttttgacagaaataaagatggtcggttggatctaaatgacttagcaaggattctggctcttcaggaaaacttccttctccaatttaaaatggatgcttgttctactgaagaaaggaaaagggactttgagaaaatctttgcctactatgatgttagtaaaacaggagccctggaaggcccagaagtggatgggtttgtcaaagacatgatggagcttgtccaggcttttgcatttctgatgactggatggccccactggatccatgactcttgactcaactggtcctatggccactactcagaagtggactcagcttcaggaaggccattttccctatccctatgattgctttctcaaccaatcagcagcacccattccctagccccctgcttgccaaactatctttgaaaaaccctagcctccaaattttcggggaggttagtttgagtagtaataaaactctagtctcccttctagcctgttttacatgtattaaactgtttctctattgcaatttccttatattgataaattggctttatctgggcagcaggcaaaagaaacccattgggtggttaca

SEQ ID NO: 2837 - DNA, 443 bp, Artificial Sequence
  Synthetic polypeptide
atgggaagcgcggttatggacaccaagaagaaaaaagatgtttccagccccggcgggagcggcggcaagaaaaatgccagccagaagaggcgttcgctgcgcgtgcacattccgggtcgtttccgatgtgatgagttttgatgaggccacattggagcaggctggcccttttccacatggctggcatctgcgtatgagggggattctggacacagatatgcccggagagacctctggtgaggatgaaggtggagatcaaggtgatgcttctacaagccaggaaaccccaaagatggccggcagccacccgtagctggcagaaaggcctggacagattctccctctcagcctcagagagacccagccctgccgacaccttgatctcggacttccgggctccggaactgggagatggtgcgtttctgttgttcaaagccccccag

SEQ ID NO: 2838 - DNA, 6094 bp, Artificial Sequence
  Synthetic polypeptide
atgaaagactccgaagggccccagaggcccccgctgtgttttttatctacattgctttcccagaaggttcctgagaagtcagacgctgtgcttcgctgcataatatctggtcagcccaagccagaggtaacttggtataagaatggtcaggccatcgatgggagtggcattatttccaactatgaattctttgagaatcagtatattcatgtgttacatctctcttgctgtaccaaaaatgatgctgctgtctatcaaatctcggctaaaaactcttttggaatgatctgttgttctgcttccgttgaggttgagtgctcatcagagaacccacaattgtctcctaacctggaagatgacagggacaggggttggaaacatgaaacagggacacatgaagaagaaagggcaaatcagattgatgagaaggaacatccttataaggaagaagaaagcatctccccgggcactcccaggtcagctgactcctccccctccaaatccaaccattcactctccctccagtcattgggcaatcttgacattagtgtgtccagttctgaaaatcctttgggtgttaaaggaacaaggcacactggagaggcttatgatccaagtaacacagaagaaattgcaaatgggttgctttttcttaattcaagtcatatttatgaaaaacaagacagatgttgccacaagacagtgcattccatggcatcaaagttcacggatggtgacctgaacaatgatggtcctcatgatgaaggcttacgctctagtcagcaaaatcccaaagtacagaaatacattagcttcagcctcccgctatctgaggcaactgcacacatttacccaggtgacagtgccgtggccaacaaacaacccagcccacagctttccagtgaagactctgacagtgactatgaactttgcccagagataaccctaacctacaccgaggagttttcagatgatgacctggagtatctggaatgttctgatgttatgacggattactctaatgcagtttggcaaaggaacctgctggggactgagcatgtttttttattagaaagcgatgacgaagagatggaattcggtgagcattgcctgggtgggtgtgagcatttcctcagtggaatgggttgtgggtctcgggtgtcgggtgacgctgggcctatggttgccactgctggcttctgtggtcatcactcacaaccccaagaagttggggtgaggagcagcagagtctccaagcacggtccctcatccccacaaacagggatgactctcattttgggacctcaccaggatggaacgtcttcagtgacagaacaggggagatataaactccccactgctcccgaggctgctgaaaatgattatccaggaattcaaggagaaaccagagacagccaccaagcaagagaggaatttgccagtgacaatctgctcaacatggatgaatcagtaagagagacagagatgaagctcttgtctggtgagtcagaaaactcagggatgagccagtgttgggagacggcagctgacaagagagtggggggaaaggacttatggagcaagaggggttcaaggaaatctgccagggtgaggcagccgggaatgaagggaaatcccaagaagccgaatgccaacctgagagaaagtacaacagaaggtacccttcatctctgctctgccaaagaatctgctgagcccccactaacccagagtgataaaagagagacttctcacaccacagcagcagcgactggtcggagttcccatgctgatgcaagagaatgtgctatttcaacccaggcagagcaagaagcaaaaacccttcaaacttcaacagactcagtctccaaagaaggcaacacaaattgcaagggagaaggcatgcaagttaatactctatttgaaacaagccaggttccagactggagtgatcctcctcaggtacaagttcaggaaacagtcagagagacaatctcttgcagccagatgccagctttctcagagcctgctggggaggagtccccattcactgggaccacaacaatttccttctcaaacttaggaggggtccacaaggaaaatgcatcattagctcaacactcggaggtcaaaccctgtacctgtggtccacagcatgaagaaaaacaagacagagatggcaacatacctgacaatttcagggaagacctaaaatatgagcagagcatctcagaagccaatgatgagactatgtccccaggtgtgttctcaaggcatctccccaaggatgctcgtgctgacttcagggagcctgtggctgtctctgttgcttcccctgaacccacagatactgccctcaccctggaaaatgtgtgtgatgagccaagggacagagaagcagtgtgtgcaatggagtgttttgaggctggtgaccaaggaacgtgttttgataccatagattctcttgttgggagaccagttgataaatattcgcctcaagaaatttgctctgtagatacggaactggcagaaggtcaaaacaaagtatctgatttatgttcttctaatgacaagacactggaagtcttttttcagacacaagtgtctgagacttcagtgtctacgtgcaaaagcagcaaggacggcaactcagtcatgtcccctctttttaccagtactttcaccttgaacatttcacacacagctagtgaaggtgccacaggagaaaatctagccaaggtggagaattccacctacccactggcctccacagtacatgctggccaggagcagccaagccccagcaactcaggagggcttgatgaaacacagctcctttcttctgagaacaatcctttagtgcaatttaaagaaggaggtgacaagagccccagtcctagtgccgcagacaccacagccacaccagccagttatagttcaattgtgagttttccttgggagaagccaacaacattaactgctaataatgagtgctttcaagcgaccagggagactgaggacacatcaactgttaccattgccaccgaagtccacccagccaaataccttgctgtgtcaattcctgaggacaagcatgcaggtggcactgaggagaggttccctcgtgcatcccatgaaaaggtttcccaatttccttcccaagtgcagttggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggcccactcacccgcaagctctagggaaggagcagggcagcgctcaggttgggggacgagggtctccgtggtggctgaaactgctggggaagaagacagtcaggctctgagcaacgttccatctctctctgatatccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacattggagaagtctttcttcccggggtttcagccaacccagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacagggcgccagagaagggggtcaatcaaatgacggaaacatgggccacgaagcggaaatccagccggccattttgcaagttccatgtctccagggaaccattctgagtgaaaatagaatcagcagaagccaagaaggcagtatgaagcaggaggctgaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcacgcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctagctcctcagcgaagaccttggcatttatttcaggagaacgtgagttagagaaagcccctaaattactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagagaaacaagacccaaaaaagccatcttgcaaaagagaaggaagagctccagtattactgaaaaagatccaagctgagatgttccctgaacactctggaaatgtaaaattaagctgccaatttgcagaaattcatgaagattctactatctgctggacaaaagattcaaagtccatagcccaagtgcagagaagtgcaggggacaactccactgtttcctttgccatcgtgcaagccagtccgaaggaccagggactctattactgctgcatcaagaacagctacggaaaagtgactgctgaatttaacctcacagctgaagttctcaaacagctgtcaagtcgccaggatactaaaggatgtgaagagattgaattcagccaactcatcttcaaagaagacttcctccatgacagctactttgggggccgcctgcgtggtcagatcgccacggaggagctgcactttggagaaggggttcaccgcaaagccttccgcagcacagtgatgcacggcctcatgcctgtcttcaaacctggccatgcctgtgtgcttaaggtgcacaatgccattgcctatgggaccagaaataatgatgagctcatccaaaggaactacaaactcgctgcccaggaatgctatgttcaaaatactgccaggtattatgccaagatctacgctgctgaagcacagcctctggaaggctttggagaagtacctgagaatagcatctggaagagtatctgacacatacaggccactgaataaatattggttgactgaatga

SEQ ID NO: 2839 - DNA, 565 bp, Artificial Sequence; identical to SEQ ID NO: 1420
  Synthetic polypeptide

SEQ ID NO: 2840 - DNA, 1736 bp, Artificial Sequence; identical to SEQ ID NO: 156
  Synthetic polypeptide

SEQ ID NO: 2841 - DNA, 1724 bp, Artificial Sequence; identical to SEQ ID NO: 157
  Synthetic polypeptide

SEQ ID NO: 2842 - DNA, 535 bp, Artificial Sequence; identical to SEQ ID NO: 2819
  Synthetic polypeptide

SEQ ID NO: 2843 - DNA, 1470 bp, Artificial Sequence
  Synthetic polypeptide
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttggggtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagttggaatgcagatgggaaggtgagcaagcttggaccatgaagacaaaggcaacacccgagagatggagcagcttcaagttgaagggagcctgag

SEQ ID NO: 2844 - DNA, 1968 bp, Artificial Sequence
  Synthetic polypeptide
atggagaacgacccctcgagacgaagagagtccatctctctcacacctgtggccaagggtctggagaacatgggggctgatttcttggaaagcctggaggaaggccagctccctaggagtgacttgagccccgcagagatcaggagcagctggagcgaggcggcgccgaagcccttctccagatggaggaacctgcagccagccctgagagccagaagcttctgcagggagcacatgcagctgtttcgatggatcggcacaggcctgctctgcactgggctctctgccttcctgctggtggcctgcctcctggatttccagagggccctggctctgtttgtcctcacctgtgtggtcctcaccttcctgggccaccgcctgctgaaacggcttctggggccaaagctgaggaggtttctcaagcctcagggccatccccgcctgctgctctggtttaagaggggtctagctcttgctgctttcctgggcctggtcctgtggctgtctctggacacctcccagcggcctgagcaactggtgtccttcgcaggaatctgcgtgttcgtcgctctcctctttgcctgctcaaagcatcattgcgcagtgtcctggagggccgtgtcttggggacttggactgcagtttgtacttggactcctcgtcatcagaacagaaccaggattcattgcgttcgagtggctgggcgagcagatccggatcttcctgagctacacgaaggctggctccagcttcgtgtttggggaggcgctggtcaaggatgtctttgcctttcaggttctgcccatcattgtctttttcagctgtgtcatatccgttctctaccacgtgggcctcatgcagtgggtgatcctgaagattgcctggctgatgcaagtcaccatgggcaccacagccactgagaccctgagtgtggctggaaacatctttgtgagccagaccgaggctccattactgatccggccctacttggcagacatgacactctctgaagtccacgttgtcatgaccggaggttacgccaccattgctggcagcctgctgggtgcctacatctcctttgggatcgatgccacctcgttgattgcagcctctgtgatggctgccccttgtgccttggccctctccaagctggtctacccggaggtggaggagtccaagtttaggagggaggaaggagtgaaactgacctatggagatgctcagaacctcatagaagcagccagcactggggccgccatctccgtgaaggtggtcgccaacatcgctgccaacctgattgcgttcctggctgtgctggactttatcaatgctgccctctcctggctgggagacatggtggacatccaagggctcagcttccagctcatctgctcctacatcctgcggcctgtagccttcttgatgggtgtggcgtgggaggactgcccagtggtagctgagctgctggggatcaagctgtttctgaacgagtttgtggcctatcaagacctctccaagtacaagcaacgccgcctggcaggggccgaggagtgggtcggcgacaggaagcagtggatctccgtcagagctgaagtcctcacgacgtttgccctctgtggatttgccaatttcagctccattgggatcatgctgggaggcttgacctccatggtcccccaacggaagagcgacttctcccagatagtgctccgggcgctcttcacgggagcctgtgtgtccctggtgaacgcctgtatggcagggatcctctacatgcccaggggggctgaagttgactgcatgtccctcttgaacacgaccctcagcagcagtagctttgagatttaccagtgctgccgtgaggccttccagagttggaatgcagatgggaaggtgagcaagcttggaccatgaagacaaaggcaacacccgagagatggagcagcttcaagttgaagggagcctgag

SEQ ID NO: 2845 - DNA, 843 bp, Artificial Sequence
  Synthetic polypeptide
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatggtctccttacctgagaaatgggaatgcccaagctgctgcctcattggctgtttggctgattacatcactggctgagcctgaggccccggacggtgcctgaca

SEQ ID NO: 2846 - DNA, 591 bp, Artificial Sequence
  Synthetic polypeptide
atggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatggtctccttacctgagaaatgggaatgcccaagctgctgcctcattggctgtttggctgattacatcactggctgagcctgaggccccggacggtgcctgaca

SEQ ID NO: 2847 - DNA, 324 bp, Artificial Sequence
  Synthetic polypeptide
gacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatggtctccttacctgagaaatgggaatgcccaagctgctgcctcattggctgtttggctgattacatcactggctgagcctgaggccccggacggtgcctgaca

SEQ ID NO: 2848 - DNA, 1048 bp, Artificial Sequence
  Synthetic polypeptide
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2849 - DNA, 814 bp, Artificial Sequence
  Synthetic polypeptide
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggaatgttactgggatgctttactgccatcctcataggtggcttcattagtgaaacccttgggtggccctttgtcttctatatctttggaggtgttggctgtgtctgctgccttctctggtttgttgtgatttatgatgaccccgtttcctatccatggataagcacctcagaaaaagaatacatcatatcctccttgaaacaacaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2850 - DNA, 409 bp, Artificial Sequence
  Synthetic polypeptide
atggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2851 - DNA, 617 bp, Artificial Sequence
  Synthetic polypeptide
agggggcggggctgagggacgcagtgcctgggcggtaggcccggtgggcggggctggagaagagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2852 - DNA, 904 bp, Artificial Sequence
  Synthetic polypeptide
atgggcgcccggctatcgcggcgacggctgccggcggacccatccctggccctggacgcgctgcccccggagctgctggtgcaggtgctgagccacgtgccgccacgctccttggtcacgcgatgccgcccagtgtgccgcgcctggcgcgacatagtggacgggcccactgtgtggctgctgcagctggcccgcgaccgcagcgccgagggccgcgcactctacgcagtggctcaacgctgcctgcccagcaacgaagacaaggaggagttcccgctgtgcgccctggcgcgctactgtctgcgcgcgcccttcggccgcaatctcatcttcaactcctgcggagagcagggcttcagaggctgggaggtggagcatggcgggaacggctgggccatagaaaagaacctaacaccggtgcctggggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2853 - DNA, 480 bp, Artificial Sequence
  Synthetic polypeptide
gggctccttcgcagacctgcttcgtgacctctttcgaatggtgctccaagaggcagcttgtggacctggtgatggaaggggtgtggcaggagctgctggacagcgcccagattgagatctgtgtggctgactggtggggcgctcgagagaactgcggctgcgtctaccagctccgggtccgccttctggatgtgtatgaaaaggaagtggtcaagttctcagcctcacctgacccggtccttcagtggactgagaggggctgccgacaggaggccaagatgggaggacagcttgagggcaggagtttgaggccagcctgggcaatatagcgagacctccatctctacaaagaaattaaaaattagacgggcatggtgacttgcacctgcagtctcagctactcaggaggctgaggtgggaggatggttggagcccagttggtcccactgcactccagccagggcaacagactgagacgct

SEQ ID NO: 2854 - DNA, 1742 bp, Artificial Sequence
  Synthetic polypeptide
atgaagccaggtgctactggcgagtccgatttggccgaagtgctgccccagcacaagttcgacagcaagtccctggaggcctacctaaaccagcacttgtctggctttggggccgaacgtgaggctacgctgaccattgcccagtacagagcaggaaagtccaatccaaccttttatctccagaagggctttcaaacatatgtgctcaggaaaaaaccaccaggttcacttcttcctaaagcacatcagattgatagagaatttaaagtccagaaagccttgttttcaattggattccccgttcccaagcctatactgtactgcagtgatacttctgtcattggaacagaattttacgtaatggaacatgtgcagggtcgaatcttccgtgatttaacaattcctggacttagcccagcagaacgttcagccatatatgtggccacggtagaaacattggctcagttacgttccttgaatatacagtcactgcagctggaaggatatggtataggtgctgggtactgcaaaagacaggtatcaacctggacaaagcaatatcaagctgcagctcatcaggacatccctgccatgcaacagctatcggagtggctaatgaagaacttgcccgataatgacaatgaagagaatttgattcatggagatttcagactagataacatagttttccaccctaaagagtgtcgagttatagcagtgctggattgggagctgtcaaccattggtcatcctttgtcagacttagctcatttttccctgttctacttttggccaaggacagttccaatgataaatcaaggttcttatagtgaaaactcagggataccatcaatggaagaactgatttcaatatattgccgctgcaggggaattaattctattcttcctaactggaatttctttcttgccctttcatattttaagatggctggaatagcacagggagtatatagcagatatcttctgggaaataattcatctgaggatagctttttatttgccaatattgtgcaacctctggcagaaactggactacaactctccaaacgaactttcagtactgtactaccacagattgatactactggacagttgtttgtacagactcggaaaggtcaggaagttcttattaaggtgaagcatttcatgaaacaacacattcttccagctgaaaaggaggtaactgagttctatgttcaaaatgaaaattcagtggacaagtggggaaaacctttagtgattgataaactcaaggaaatggccaaagtcgagggtctctggaacttgtttttgccagctgtcagcggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggaggctgaggcaggagatttgcttgaccccgggtggcggaagttgacatgcgctgagatggcaccactgtacttcaccctgggcaacaagagcgaaactctgtctcaaaaaaatgaaaaaa

SEQ ID NO: 2855 - DNA, 317 bp, Artificial Sequence
  Synthetic polypeptide
atggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggaggctgaggcaggagatttgcttgaccccgggtggcggaagttgacatgcgctgagatggcaccactgtacttcaccctgggcaacaagagcgaaactctgtctcaaaaaaatgaaaaaa

SEQ ID NO: 2856 - DNA, 416 bp, Artificial Sequence
  Synthetic polypeptide
ggactcagccacgtggactatgccttgattgctgaagaaacaggaaaatgcttttttgctccagatgtctttaactgccaagcaccagacacagggaatatggaggttctgcacctgtatggaagtgaggaacagaagaaacagtggcttgagcctcttcttcaagggaacattacctcttgcttctgtatgacagaacctgatgtagcttcaagtgatgccacgaatattgaatgcagcatccaacgagatgaagatagctatgtaattaacggcaaaaaatggtggagcagtggaggctgaggcaggagatttgcttgaccccgggtggcggaagttgacatgcgctgagatggcaccactgtacttcaccctgggcaacaagagcgaaactctgtctcaaaaaaatgaaaaaa

SEQ ID NO: 2857 - DNA, 1097 bp, Artificial Sequence; identical to SEQ ID NO: 1040
  Synthetic polypeptide

SEQ ID NO: 2858 - DNA, 965 bp, Artificial Sequence; identical to SEQ ID NO: 1041
  Synthetic polypeptide

SEQ ID NO: 2859 - DNA, 307 bp, Artificial Sequence; identical to SEQ ID NO: 2622
  Synthetic polypeptide

SEQ ID NO: 2860 - DNA, 357 bp, Artificial Sequence
  Synthetic polypeptide
atgtgcaaaggacttgcagctttgccccactcatgcctggaaagggacctggatgaagctggaaaccatcattctcagcaaactattgcaaggacaaaaaaccaaacagcacatgttctcactcataggtgggaattgaacaatgagaacacatggacacaggaagaggaacatcacacaccagggactgttgtggggtagggggaggggggagggatagcattgggagatatacctaatgctaaatgacgagttgatgggtgcagcacaccaacatggtacatgtatacatatgtaacaaacctgcatgttgtgcacaggtaccctaaaacttaaagtataataataataaaaaaa

SEQ ID NO: 2861 - DNA, 1038 bp, Artificial Sequence
  Synthetic polypeptide
atgtgtccaggcttacccagacctatgtcacgatcttcattccagctcttcctgcaacctttctttatatgttacaagttaaatatttgctcaaccaggttgagttccagcccgatggccagatctcctggaaatgtgtgtgtcccccccacaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagattttgcctctacatttttgactt

SEQ ID NO: 2862 - DNA, 1554 bp, Artificial Sequence
  Synthetic polypeptide
atggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcgacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagattttgcctctacatttttgactt

SEQ ID NO: 2863 - DNA, 1623 bp, Artificial Sequence
  Synthetic polypeptide
atggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagagattttgcctctacatttttgactt

SEQ ID NO: 2864 - DNA, 606 bp, Artificial Sequence
  Synthetic polypeptide
atgtctggtggagaacagaaaccagagaggtactatgtgggtgtggacgttggaacaggcagtgtccgtgcagctctggtggaccagagtggggtcctgttggcttttgcagaccagccaattaagaattgggagccccagttcaaccaccatgagcagtcctccgaggacatctgggctgcgtgctgtgttgtcacaaagaaagttgtacaagggattgatttaaaccaaattcgaggacttgggtttgatgccacgtgttctctggttgttttggataagcagtttcacccattaccagtcaaccaggaaggggattcccatcgaaacgtcatcatgtggctggaccatcgagcagtcagtcaagttaacaggatcaatgagaccaagcacagtgtcctccagtacgtcgggggggtgatgtctgtggaaatgcaggccccgaaacttctgtggctgaaagagctactcgggaggctgaggcaggagaatctcttgaacccggggtgcagaggttgcagtgagctgagatcgcaccactacactccagcctggcgatagagtgagactccatctcaaaaaagaaaaaaaaaaaaaaaaaagaaa

SEQ ID NO: 2865 - DNA, 523 bp, Artificial Sequence; identical to SEQ ID NO: 1604
  Synthetic polypeptide

SEQ ID NO: 2866 - DNA, 661 bp, Artificial Sequence; identical to SEQ ID NO: 1605
  Synthetic polypeptide

SEQ ID NO: 2867 - DNA, 493 bp, Artificial Sequence; identical to SEQ ID NO: 1606
  Synthetic polypeptide

SEQ ID NO: 2868 - DNA, 463 bp, Artificial Sequence; identical to SEQ ID NO: 1607
  Synthetic polypeptide

SEQ ID NO: 2869 - DNA, 436 bp, Artificial Sequence; identical to SEQ ID NO: 1608
  Synthetic polypeptide

SEQ ID NO: 2870 - DNA, 496 bp, Artificial Sequence; identical to SEQ ID NO: 1609
  Synthetic polypeptide

SEQ ID NO: 2871 - DNA, 595 bp, Artificial Sequence; identical to SEQ ID NO: 1610
  Synthetic polypeptide

SEQ ID NO: 2872 - DNA, 634 bp, Artificial Sequence; identical to SEQ ID NO: 1611
  Synthetic polypeptide

SEQ ID NO: 2873 - DNA, 1652 bp, Artificial Sequence
  Synthetic polypeptide
atgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatggtaagtaagcacatgaaaagatgttcaccatcattagctagcagggaaaaaatacaaattaagagcacaataaaagatcactgcacacctctcagaatggctgaaataaaagtgacgacacaaatgctgccaaggttgaggagaaacataatctctcaggtgttgctggtgggaatgaaaattagccactctgaaaaacagtttagtgtttatgttttgttttttttttaataataaaagtaagcttgtgattactgtacaacccagcatttgcaggactaggtgtttatcgtagagaaagggaaaattacattcacataaaaacttgtgcatgaatgttgatagcagcttttttcctaatagctaaaagtgggaaacaactcaaatgtcctttaatgggtgaacagttaaacaactggtcatccatccataccatggaaatatagcaataaaaaggaatgaactctagatacaaggaacagtctggacgaatctctagagaattatgctgagtgaaaaaagataatctcaaaagataaccttctgtatgcttccatttacattacattttcaaaatgtcaaaattatagtcttggagaacagattagtggctgccaggggatttaggggtaggaactctaaagttcacaaaggagccttggggtgatgaccaattctgggtcttaaatgtggtagtagttacacagatctacacatgtgataaaactgcatagaactgtatagacacacatagatgaatgtatgtaaaactggtggaatccgaataaagtttgtgggttgtgccaatgtccatttcttgttttttgataatgttacgccgtttccctttgaggggaaactagtgaaagggtacataggacctgttgtactttttttgggcagcttctggtgaatccttataattatttcaaaataaaaagtt

SEQ ID NO: 2874 - DNA, 2173 bp, Artificial Sequence
  Synthetic polypeptide
atgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaac

SEQ ID NO: 2875 - DNA, 460 bp, Artificial Sequence
  Synthetic polypeptide
actacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaagttaccagaggtccaccacagtctgaatgtattaaataggaaattccagaagcaaacagttcataacctttaaagcacgcgccgttctgcacagtctggtgagatcttgatctgtcctgcccaggactcggattctccctttgtccaac

SEQ ID NO: 2876 - DNA, 670 bp, Artificial Sequence
  Synthetic polypeptide
atgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggggtcagccgcaactaagaagtatgaagggtagagaaaaatttcttctcctctcctaca

SEQ ID NO: 2877 - DNA, 604 bp, Artificial Sequence
  Synthetic polypeptide
gagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggggtcagccgcaactaagaagtatgaagggtagagaaaaatttcttctcctctcctaca

SEQ ID NO: 2878 - DNA, 550 bp, Artificial Sequence
  Synthetic polypeptide
atgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggggtcagccgcaactaagaagtatgaagggtagagaaaaatttcttctcctctcctaca

SEQ ID NO: 2879 - DNA, 500 bp, Artificial Sequence; identical to SEQ ID NO: 204
  Synthetic polypeptide

SEQ ID NO: 2880 - DNA, 656 bp, Artificial Sequence; identical to SEQ ID NO: 205
  Synthetic polypeptide

SEQ ID NO: 2881 - DNA, 524 bp, Artificial Sequence; identical to SEQ ID NO: 207
  Synthetic polypeptide

SEQ ID NO: 2882 - DNA, 620 bp, Artificial Sequence; identical to SEQ ID NO: 2592
  Synthetic polypeptide

SEQ ID NO: 2883 - DNA, 1292 bp, Artificial Sequence; identical to SEQ ID NO: 2593
  Synthetic polypeptide

SEQ ID NO: 2884 - DNA, 1400 bp, Artificial Sequence; identical to SEQ ID NO: 2594
  Synthetic polypeptide

SEQ ID NO: 2885 - DNA, 1310 bp, Artificial Sequence; identical to SEQ ID NO: 2595
  Synthetic polypeptide

SEQ ID NO: 2886 - DNA, 497 bp, Artificial Sequence; identical to SEQ ID NO: 2596
  Synthetic polypeptide

SEQ ID NO: 2887 - DNA, 412 bp, Artificial Sequence; identical to SEQ ID NO: 2597
  Synthetic polypeptide

SEQ ID NO: 2888 - DNA, 610 bp, Artificial Sequence; identical to SEQ ID NO: 163
  Synthetic polypeptide

SEQ ID NO: 2889 - DNA, 842 bp, Artificial Sequence
  Synthetic polypeptide
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaaggctcctgtgtatgactggtctcctcaaatccaaggcatcatctttggtgctgttggctatggtggcatactgacaatggctcccagtggatacctggctggaagagtaggaacaaagcgagtggttggcatttctttgtttgcaacttcatttctcactctatgcatccctctggccactgactttggaatagtcttgctcattgtaactcgaatagtccagggcctaagccagtcctcaatacttgggggtcagtttgcaatttgggaaaagtggggccctccacaagaacgaagcagactctgcagcattgctttatcaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2890 - DNA, 608 bp, Artificial Sequence
  Synthetic polypeptide
atggccaccaagacagagttgagtcccacagcaagggagagcaagaacgcacaagatatgcaagtggatgagacactgatccccaggaaagttccaagtttatgttctgctcgctatggaatagccctcgtcttacatttctgcaatttcacaacgatagcacaaaatgtcatcatgaacatcaccatggtagccatggtcaacagcacaagccctcaatcccagctcaatgattcctctgaggtgctgcctgttgactcatttggtggcctaagtaaagccccaaagagtcttcctgcaaagtcctcaatacttgggggtcagtttgcaatttgggaaaagtggggccctccacaagaacgaagcagactctgcagcattgctttatcaggctgaactcccttgtccaggcaaccacccagaaacccattgatgccatccttctcctctgccaagtttggtatcagcagctccaggaaaacaactctgaagttggacacccactacttcaaaaccccaaccctgataacagagcccctgttcagcaggaagcaaccagatagtcaacaacacccctttcccttttatattaaagtagaaggcaagaa

SEQ ID NO: 2891 - DNA, 734 bp, Artificial Sequence; identical to SEQ ID NO: 930
  Synthetic polypeptide

SEQ ID NO: 2892 - DNA, 1825 bp, Artificial Sequence; identical to SEQ ID NO: 1660
  Synthetic polypeptide

SEQ ID NO: 2893 - DNA, 1825 bp, Artificial Sequence; identical to SEQ ID NO: 1661
  Synthetic polypeptide

SEQ ID NO: 2894 - DNA, 980 bp, Artificial Sequence; identical to SEQ ID NO: 2726
  Synthetic polypeptide

SEQ ID NO: 2895 - DNA, 2721 bp, Artificial Sequence; identical to SEQ ID NO: 962
  Synthetic polypeptide

SEQ ID NO: 2896 - DNA, 2549 bp, Artificial Sequence; identical to SEQ ID NO: 963
  Synthetic polypeptide

SEQ ID NO: 2897 - DNA, 3308 bp, Artificial Sequence; identical to SEQ ID NO: 428
  Synthetic polypeptide

SEQ ID NO: 2898 - DNA, 3203 bp, Artificial Sequence; identical to SEQ ID NO: 429
  Synthetic polypeptide

SEQ ID NO: 2899 - DNA, 2849 bp, Artificial Sequence; identical to SEQ ID NO: 430
  Synthetic polypeptide

SEQ ID NO: 2900 - DNA, 388 bp, Artificial Sequence; identical to SEQ ID NO: 431
  Synthetic polypeptide

SEQ ID NO: 2901 - DNA, 860 bp, Artificial Sequence; identical to SEQ ID NO: 2285
  Synthetic polypeptide

SEQ ID NO: 2902 - DNA, 1823 bp, Artificial Sequence; identical to SEQ ID NO: 2286
  Synthetic polypeptide

SEQ ID NO: 2903 - DNA, 1796 bp, Artificial Sequence; identical to SEQ ID NO: 2287
  Synthetic polypeptide

SEQ ID NO: 2904 - DNA, 322 bp, Artificial Sequence; identical to SEQ ID NO: 2729
  Synthetic polypeptide

SEQ ID NO: 2905 - DNA, 465 bp, Artificial Sequence; identical to SEQ ID NO: 2730
  Synthetic polypeptide

SEQ ID NO: 2906 - DNA, 1663 bp, Artificial Sequence; identical to SEQ ID NO: 2731
  Synthetic polypeptide

SEQ ID NO: 2907 - DNA, 1429 bp, Artificial Sequence; identical to SEQ ID NO: 2732
  Synthetic polypeptide

SEQ ID NO: 2908 - DNA, 1813 bp, Artificial Sequence
  Synthetic polypeptide
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccagatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 2909 - DNA, 1813 bp, Artificial Sequence
  Synthetic polypeptide
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccagatgtctgcggaaacatccctcgtcagaagcgcttgctcagttgtacacatgagcccgagggtcctcagcttttctttccataggttccagaggccgtagtttctttgtaagactctaggtgtttatgtgattattggcttaatgtctatttccttcccaggccccataaggggagggctgagtctgtcccgtttatcattaaatcctcagctcaagcccctagcctggcacgcagtaggtgctcaacagaatgaagggaggaatgaat

SEQ ID NO: 2910 - DNA, 377 bp, Artificial Sequence; identical to SEQ ID NO: 2235
  Synthetic polypeptide

SEQ ID NO: 2911 - DNA, 347 bp, Artificial Sequence; identical to SEQ ID NO: 2236
  Synthetic polypeptide

SEQ ID NO: 2912 - DNA, 154 bp, Artificial Sequence; identical to SEQ ID NO: 2227
  Synthetic polypeptide

SEQ ID NO: 2913 - DNA, 209 bp, Artificial Sequence
  Synthetic polypeptide
atggacacaagtcccctgtgtttctccattctgttggttttatgcatctttatccaatcaagtgcccttggacaaagcctgaaaccagagctggtcaagcaagaagagcactggactacgcatcaagacctggggtgctgatcccgactctcatccttgactgcagtgtgggctgggcaggtcacttcactgctctgagcgatttagtt

SEQ ID NO: 2914 - DNA, 1271 bp, Artificial Sequence
  Synthetic polypeptide
atggccaagcgagttgccattgtgggagctggggtcagcggcctggcctccatcaagtgctgtctggaagaaggactggagcccacctgctttgagaggagcgatgaccttggggggctgtggagattcaccgaacatgttgaagaaggcagagccagtctctacaagtctgtggtttccaacagctgcaaggagatgtcttgttactcagactttccattcccagaagattatccaaactatgtgccaaattctcaattcctggaatatctcaaaatgtatgcaaaccactttgaccttctgaaacacattcaattcaagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttgaataaagtttattga

SEQ ID NO: 2915 - DNA, 1082 bp, Artificial Sequence
  Synthetic polypeptide
atggccaagcgagttgccattgtgggagctggggtcagcggcctggcctccatcaagtgctgtctggaagaaggactggagcccacctgctttgagaggagcgatgaccttggggggctgtggagattcaccaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtattaatgcctttaaaggccagtactttcatagccggcaatataagcatccagatatatttaaggacaagagagtccttgtgattggaatgggaaattctggcacagacattgctgtggaggccagccacctggcggaaaaggtgttcctcagcaccaccggagggggatgggtgatcagccgaatctttgactcgggctacccatgggacatggtgttcatgacacgctttcagaacatgttgagaaattccctcccaaccccaattgtgacttggttgatggagcgaaagataaacaactggctcaatcatgcaaattacggcttaataccagaagacaggactcagctgaaagagtttgtgctaaatgatgagctcccaggacgcatcatcactgggaaagtgttcatcaggccaagcataaaagaggtaaaggaaaactctgtcatatttaacaatacttcaaaggaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtgtaaataagttaccaccaccaagtgtcatgatagaggaaattaatgcaaggaaagaaaacaagcccagttgaataaagtttattga

SEQ ID NO: 2916 - DNA, 881 bp, Artificial Sequence; identical to SEQ ID NO: 2412
  Synthetic polypeptide

SEQ ID NO: 2917 - DNA, 803 bp, Artificial Sequence; identical to SEQ ID NO: 2413
  Synthetic polypeptide

SEQ ID NO: 2918 - DNA, 914 bp, Artificial Sequence
  Synthetic polypeptide
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatgggtccttggcagatgagatgacctaacgtggcaaagtggttagaccagcg

SEQ ID NO: 2919 - DNA, 620 bp, Artificial Sequence
  Synthetic polypeptide
atgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatgggtccttggcagatgagatgacctaacgtggcaaagtggttagaccagcg

SEQ ID NO: 2920 - DNA, 790 bp, Artificial Sequence
  Synthetic polypeptide
atgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagcttccctctgggcagtaactctaccaacccctccacagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtg

SEQ ID NO: 2921 - DNA, 752 bp, Artificial Sequence
  Synthetic polypeptide
atgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctggtttggacagagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtg

SEQ ID NO: 2922 - DNA, 742 bp, Artificial Sequence
  Synthetic polypeptide
atgggcaccgagaaagaaagcccagagcccgactgccagaaacagttccaggctgcagtgagcgtcatccagaacctgcccaagaacggttcttaccgcccctcctatgaagagatgctgcgattctacagttactacaagcaggccaccatggggccctgcctggtcccccggcccgggttctgggaccccattggacgatataagtgggacgcctggaacagtctgggcaagatgagcagggaggaggccatgtctgcctacatcactgaaatgaaactggtggcacagaaggtgatcgacacagtgcccctgggtgaggtggcagaggacatgtttggttacttcgagcccctgtaccaggtgatccctgacatgccgaggcccccagagaccttcctgagaagggtcacaggttggaaagagcaggttgtgaatggagatgttggggctgtttcagagcctccctgcctccccaaggaaccggcacccccaagcccagagtcccattcacccagggacctggactccgaggttttctgtgattccctggagcagctggagcctgagctgagcagcgggcagcatctggaggaaagcgtgatcccaggaacagccccgtgccccccacaaagaaagctgcacagcctcaggaagtcatccatattctctggactcccccgtttggaaatctcagaagacaatgagttctgccctcttcccttctagaactcctgttgtg

SEQ ID NO: 2923 - DNA, 816 bp, Artificial Sequence
  Synthetic polypeptide
atggcaaaacagaagagaaaagttcctgaagtgacagagaaaaagaacaaaaagctgaagaaggcgtcagcagaggggccactgctgggccctgaggctgcaccaagtggcgaaggagccggctccaagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggacacctgtgccgtggacccagccgccatgctgtggggaagcccagcagctcgtagaggggcccatgtggaggggaacccaggcccacggaaccgtggccaggcttccacatgacactgagcccacctgcctgccagccacgtgtgccatcgtgagtggatcctccagtccgaagtggagctaacccggcccaggcctcgtggaatgtctccaccaagccctgcccaagtgcaagtgcaagttcacgggtaa

SEQ ID NO: 2924 - DNA, 769 bp, Artificial Sequence
  Synthetic polypeptide
cgcgggccgggcggtgcgcactgcgggcgcatccctgccccggcgccgtccgtgcccgcgggacctgacagccgggtcagagggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggacacctgtgccgtggacccagccgccatgctgtggggaagcccagcagctcgtagaggggcccatgtggaggggaacccaggcccacggaaccgtggccaggcttccacatgacactgagcccacctgcctgccagccacgtgtgccatcgtgagtggatcctccagtccgaagtggagctaacccggcccaggcctcgtggaatgtctccaccaagccctgcccaagtgcaagtgcaagttcacgggtaa

SEQ ID NO: 2925 - DNA, 720 bp, Artificial Sequence
  Synthetic polypeptide
gggccccaggatgcaagcacttgttttcctctgggcgaagctgtgctcaggcccgggctggacgcagagccagagctgtccccagaggagcagagggtcctggaaaggaagctgaaaaaggaacggaagaaagaggagaggcagcgtctgcgggaggcaggccttgtggcccagcacccgcctgccaggcgctcgggggccgaactggccctggactacctctgcagatgggcccaaaagcacaagaactggaggtttcagaagacgaggcagacgtggctcctgctgcacatgtatgacagtgacaaggttcccgatgagcacttctccaccctgctggcctacctggaggggctgcagggccgggcccgagagctgacggtgcagaaggcggaagccctgatgcgggagctggatgaggagggctctgatccccccctgccggggagggcccagcgcatccgacaggacacctgtgccgtggacccagccgccatgctgtggggaagcccagcagctcgtagaggggcccatgtggaggggaacccaggcccacggaaccgtggccaggcttccacatgacactgagcccacctgcctgccagccacgtgtgccatcgtgagtggatcctccagtccgaagtggagctaacccggcccaggcctcgtggaatgtctccaccaagccctgcccaagtgcaagtgcaagttcacgggtaa

SEQ ID NO: 2926 - DNA, 3536 bp, Artificial Sequence; identical to SEQ ID NO: 2823
  Synthetic polypeptide

SEQ ID NO: 2927 - DNA, 3431 bp, Artificial Sequence; identical to SEQ ID NO: 2824
  Synthetic polypeptide

SEQ ID NO: 2928 - DNA, 3077 bp, Artificial Sequence; identical to SEQ ID NO: 2825
  Synthetic polypeptide

SEQ ID NO: 2929 - DNA, 616 bp, Artificial Sequence; identical to SEQ ID NO: 2826
  Synthetic polypeptide

SEQ ID NO: 2930 - DNA, 291 bp, Artificial Sequence
  Synthetic polypeptide
atgcagaacagaactggcctcattctctgtgctcttgccctcctgatgggtttcctgatggtctgcctgggggccttcttcatttcctggggctccatattcgactgtcaggggagcctgattgcggcctatttgcttctgcctctggggtttgtgatccttctgagtggaattttctggagcaactatcgccaggtgactgaaagcaaaggagtgttgaggcacatgctccgacaacaccttgctcatggggccctgcccgtggccacagtagacagagaagagggcttc

SEQ ID NO: 2931 - DNA, 1361 bp, Artificial Sequence
  Synthetic polypeptide
atgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggtttctctgttttaatttctgtgtgataaatatgaacagacacagcccacacacgcagaccctcctgggagttttccgtaatttttaagaacatcgatgactgagactcacgagtttgagacccactg

SEQ ID NO: 2932 - DNA, 1118 bp, Artificial Sequence
  Synthetic polypeptide
atgccgcagcccgagtcccagaaggcggcgatcctgggctgcgggcaaggcggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggtttctctgttttaatttctgtgtgataaatatgaacagacacagcccacacacgcagaccctcctgggagttttccgtaatttttaagaacatcgatgactgagactcacgagtttgagacccactg

SEQ ID NO: 2933 - DNA, 282 bp, Artificial Sequence
  Synthetic polypeptide
gatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggtttctctgttttaatttctgtgtgataaatatgaacagacacagcccacacacgcagaccctcctgggagttttccgtaatttttaagaacatcgatgactgagactcacgagtttgagacccactg

SEQ ID NO: 2934 - DNA, 500 bp, Artificial Sequence; identical to SEQ ID NO: 204
  Synthetic polypeptide

SEQ ID NO: 2935 - DNA, 656 bp, Artificial Sequence; identical to SEQ ID NO: 205
  Synthetic polypeptide

SEQ ID NO: 2936 - DNA, 524 bp, Artificial Sequence; identical to SEQ ID NO: 207
  Synthetic polypeptide

SEQ ID NO: 2937 - DNA, 1038 bp, Artificial Sequence; identical to SEQ ID NO: 2861
  Synthetic polypeptide

SEQ ID NO: 2938 - DNA, 1554 bp, Artificial Sequence; identical to SEQ ID NO: 2862
  Synthetic polypeptide

SEQ ID NO: 2939 - DNA, 1623 bp, Artificial Sequence; identical to SEQ ID NO: 2863
  Synthetic polypeptide

SEQ ID NO: 2940 - DNA, 319 bp, Artificial Sequence
  Synthetic polypeptide
atggggtccagcagcttcttggtcctcatggtgtctctcgttcttgtgaccctggtggctgtggaaggagttaaagagggtatagagaaagcaggggtttgcccagctgacaacgtacgctgcttcaagtccgatcctccccagtgtcacacagaccaggactgtctgggggaaaggaagtgttgttacctgcactgtggcttcaagtgtgtgattcctgtgaaggaactggaagaagcttagaagacagcacgagagattcacattaaacccaaggaagaacttcctgctgccagggctgtcctggattggaatgggt

SEQ ID NO: 2941 - DNA, 1821 bp, Artificial Sequence
  Synthetic polypeptide
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggtgtgttggcgggcgcctgtaatcccagctactagggaggctgagacacaagaatgccttgaacccgggaggcggaggttgcagtgagccgagatcgcaccattgcactccagcctgggcaacagagtgagactccatctcaaaaaaaaa

SEQ ID NO: 2942 - DNA, 1821 bp, Artificial Sequence
  Synthetic polypeptide
atgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggtgtgttggcgggcgcctgtaatcccagctactagggaggctgagacacaagaatgccttgaacccgggaggcggaggttgcagtgagccgagatcgcaccattgcactccagcctgggcaacagagtgagactccatctcaaaaaaaaa

SEQ ID NO: 2943 - DNA, 739 bp, Artificial Sequence
  Synthetic polypeptide
atggggaatatactgacctgttgtatcaactcccactgtggctggcccagggggaaggacgcaccctgttatgaatctgatactgatatttatgagactgtggctgctgcaacatcagaatccactactgtagagcctggcaagctggatgtgggagccacggagggccaagacctgcagcacatcagcaaccaaaagatgcccacaggtccccctgaggaccgcctgagtttaaaatttctgccatcaagtgaggaagacaatgatgatgccaagattttaccatcacctgtccagggttcttctgaggacaacctgagtttagtatgcctaccacgaagtgaagatgatgactgtgatgatgatgatgatgatgatgcccagattttaccgtcacgtgtccagggtggctgttaccggtttgatagcagttcttgttcttctgaggacaacctgagtttagtatgcctaccacgaagtgaagatgatgactgtgatgatgatgatgatgatgcccagattttaccgtcacctgtccaggcttgttctgaagatagcctgtttttaagatgctcactgagacacaaagatgaagaagaagaagatgatgatgacatccacataacagctcggatagaaagtgacttgacgctggagagtctaagtgatgaagagattcatccagcatcccacaaccatggctggcagatgccaaggggatgtgtgagatggcccagct

SEQ ID NO: 2944 - DNA, 2151 bp, Artificial Sequence; identical to SEQ ID NO: 127
  Synthetic polypeptide

SEQ ID NO: 2945 - DNA, 1833 bp, Artificial Sequence; identical to SEQ ID NO: 126
  Synthetic polypeptide

SEQ ID NO: 2946 - DNA, 3727 bp, Artificial Sequence
  Synthetic polypeptide
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcacttcataaagcctgtaaaatttttagtaaaattcgaagtggtaagatttatgtgaatgatcttccagtgatcctttgcatcttgagaatttctataagtgatttagaaatgcgacaggcactaaagactgttgatattgatgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgctggactgtactgctgccatctcggctcactgcaacctccttgcctgattctcctgcctcagcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2947 - DNA, 3439 bp, Artificial Sequence
  Synthetic polypeptide
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgctggactgtactgctgccatctcggctcactgcaacctccttgcctgattctcctgcctcagcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2948 - DNA, 2305 bp, Artificial Sequence
  Synthetic polypeptide
gaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgctggactgtactgctgccatctcggctcactgcaacctccttgcctgattctcctgcctcagcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2949 - DNA, 965 bp, Artificial Sequence; identical to SEQ ID NO: 1035
  Synthetic polypeptide

SEQ ID NO: 2950 - DNA, 725 bp, Artificial Sequence; identical to SEQ ID NO: 1036
  Synthetic polypeptide

SEQ ID NO: 2951 - DNA, 884 bp, Artificial Sequence; identical to SEQ ID NO: 2542
  Synthetic polypeptide

SEQ ID NO: 2952 - DNA, 303 bp, Artificial Sequence; identical to SEQ ID NO: 148
  Synthetic polypeptide

SEQ ID NO: 2953 - DNA, 301 bp, Artificial Sequence; identical to SEQ ID NO: 147
  Synthetic polypeptide

SEQ ID NO: 2954 - DNA, 2849 bp, Artificial Sequence; identical to SEQ ID NO: 1326
  Synthetic polypeptide

SEQ ID NO: 2955 - DNA, 1925 bp, Artificial Sequence; identical to SEQ ID NO: 1327
  Synthetic polypeptide

SEQ ID NO: 2956 - DNA, 2729 bp, Artificial Sequence; identical to SEQ ID NO: 1328
  Synthetic polypeptide

SEQ ID NO: 2957 - DNA, 2549 bp, Artificial Sequence; identical to SEQ ID NO: 1329
  Synthetic polypeptide

SEQ ID NO: 2958 - DNA, 1428 bp, Artificial Sequence
  Synthetic polypeptide
atggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgtgcattgggatgatacagcaagaaggccctcaacagatgttgtcacttgatctgggacttcccagcctccagaaccgtgagccaaataaatttctgttcatcataaattactcagtctagggtattatgttatagcaacacaaaatggactaagaca

SEQ ID NO: 2959 - DNA, 1362 bp, Artificial Sequence
  Synthetic polypeptide
atggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgagacacagccatcgtcttgcttatgcagcccatgtcactcggattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgtgcattgggatgatacagcaagaaggccctcaacagatgttgtcacttgatctgggacttcccagcctccagaaccgtgagccaaataaatttctgttcatcataaattactcagtctagggtattatgttatagcaacacaaaatggactaagaca

SEQ ID NO: 2960 - DNA, 1097 bp, Artificial Sequence; identical to SEQ ID NO: 1040
  Synthetic polypeptide

SEQ ID NO: 2961 - DNA, 965 bp, Artificial Sequence; identical to SEQ ID NO: 1041
  Synthetic polypeptide

SEQ ID NO: 2962 - DNA, 3525 bp, Artificial Sequence
  Synthetic polypeptide
atgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaactactgtcttctgctgtgcctc

SEQ ID NO: 2963 - DNA, 3444 bp, Artificial Sequence
  Synthetic polypeptide
atgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgagctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgcctaccccgtgcggtgcctgctgcccagtgcccatggctcttgcgcagactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaactactgtcttctgctgtgcctc

SEQ ID NO: 2964 - DNA, 3477 bp, Artificial Sequence
  Synthetic polypeptide
atgcggctgctcctgctcgtgccgctgctgctggctccagcgcccgggtcctcggctcccaaggtgaggcggcagagtgacacctggggaccctggagccagtggagcccctgcagccggacctgtggagggggtgtcagcttccgggagcgcccctgctactcccagaggagagatggaggctccagctgcgtgggccccgcccggagccaccgctcttgtcgcacggagagctgccccgacggcgcccgggacttccgggccgagcagtgcgcggagttcgacggagcggagttccaggggcggcggtatcggtggctgccctactacagcgccccaaacaagtgtgaactgaactgcattcccaagggggagaacttctactacaagcacagggaggctgtggttgatgggacgccctgcgagcctggcaagagggatgtctgtgtggatggcagctgccgggttgtcggctgtgatcacgagctggactcgtccaagcaggaggacaagtgtctgcggtgtgggggtgacggcacgacctgctaccccgtcgcaggcacctttgacgctaatgacctcagccgaggctacaaccagatcctcatagttcccatgggtgccaccagcatcctcatcgacgaggctgctgccagcaggaacttcctggctgtgaagaatgttcgtggggaatactacctcaatgggcactggaccatcgaggcggcccgggccctgccagcagccagcaccatcctgcattacgagcggggtgctgagggggacctggcccctgagcgactccatgcccggggccccacctcggagcccctggtcatcgagctcatcagccaggagcccaaccccggtgtgcactatgagtaccacctgcccctgcgccgccccagccccggcttcagctggagccacggctcatggagtgactgcagcgcggagtgtggcggaggtcaccagtcccgcctggtgttctgcaccatcgaccatgaggcctaccccgaccacatgtgccagcgccagccacggccagctgaccggcgttcctgcaatcttcacccttgcccggagaccaagcgctggaaggcagggccatgggcaccctgctcagcctcctgtggaggaggctcccagtcccgctccgtgtactgcatctcgtctgacggggccggcatccaggaggccgtggaggaggctgagtgtgccgggctgcctgggaagccccctgccattcaggcctgtaacctgcagcgctgtgcagcctggagcccggagccctggggagagtgttctgtcagttgtggcgttggcgtccggaagcggagcgttacttgccggggtgaaaggggttctttgctccataccgcagcgtgctccttggaagaccggccacctctgactgagccctgtgtgcatgaggactgccccctcctcagtgaccaggcctggcatgttggcacctggggtctatgctccaagagctgcagctcgggcactcggaggcgacaggtcatctgtgccattgggccgcccagccactgcgggagcctgcagcactccaagcctgtggatgtggagccttgtaacacgcagccctgtcatctcccccaggaggtccccagcatgcaggatgtgcacacccctgccagcaacccctggatgccgttgggccctcaggagtcccctgcctcagactccagaggccagtggtgggcagcccaggaacacccctcagccaggggtgaccacaggggagaacgaggtgaccccaggggcgaccaaggcacccacctgtcagccctgggccccgctccctctctgcagcagcccccataccagcaacccctgcggtcgggctcagggccccacgactgcagacacagtcctcacgggtgctgccccgatggccacacggcatctctcgggcctcagtggcaaggctgccctggggccccctgtcagcagagcaggtacgggtgctgccctgacagggtatctgtcgctgaggggccccatcacgctggctgcacaaagtcgtatggtggtgacagcaccgggggcatgcccaggtcaagggcagtggcttctacagtccacaacacccaccagccccaggcccagcagaatgagcccagtgagtgccggggctcccagtttggctgttgctatgacaacgtggccactgcagccggtcctcttggggaaggctgtgtgggccagcccagccatgactgggctgcccgctggtacttcgttgcctctgtgggccaatgtaaccgcttctggtatggcggctgccatggcaatgccaataactttgcctcggagcaagagtgcatgagcagctgccagggatctctccatgggccccgtcgtccccagcctggggcttctggaaggagcacccacacggatggtggcggcagcagtcctgcaggcgagcaggaacccagccagcacaggacaggggccgcggtgcagagaaagccctggccttctggtggtctctggcggcaagaccaacagcctgggccaggggaggccccccacacccaggcctttggagaatggccatgggggcaggagcttgggtccagggcccctggactgggtggagatgccggatcaccagcgccacccttccacagctcctcctacaggattagcttggcaggtgtggagccctcgttggtgcaggcagccctggggcagttggtgcggctctcctgctcagacgacactgccccggaatcccaggctgcctggcagaaagatggccagcccatctcctctgacaggcacaggctgcagttcgacggatccctgatcatccaccccctgcaggcagaggacgcgggcacctacagctgtggcagcacccggccaggccgcgactcccagaagatccaacttcgcatcatagggggtgacatggccgtgctgtctgaggctgagctgagccgcttccctcagcccagggacccagctcaggactttggccaagcgggggctgctgggcccctgggggccatcccctcttcacacccacagcctgcaaacaggctgcgtttggaccagaaccagccccgggtggtggatgccagtccaggccagcggatccggatgacctgccgtgccgaaggcttcccgcccccagccatcgagtggcagagagatgggcagcctgtctcttctcccagacaccagctgcagcctgatggctccctggtcattagccgagtggctgtagaagatggcggcttctacacctgtgtcgctttcaatgggcaggaccgagaccagcgatgggtccagctcagagttctgggggagctgacaatctcaggactgccccctactgtgacagtgccagagggtgatacggccaggctattgtgtgtggtagcaggagaaagtgtgaacatcaggtggtccaggaactactgtcttctgctgtgcctc

SEQ ID NO: 2965 - DNA, 1151 bp, Artificial Sequence
  Synthetic polypeptide
atggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaaggactctcagaggctccacaaccctggcccaggatggactcatgacctggactgggctgatggtggtcaccatccccttgatgacagtgattggtggacacatgtactaatcagaatcattccccgacatacagacattgggacacccaaagatttttttttcctgctaaggttattcaactgggaccatgcaaataaacggtaagctgctagtgaccatctttctcagccactttgaagaagccctgcagcaggaaagaatgaggaaaatcagggctggacgatgaaaaaagagtggctcctgatatcatgatttgagccctttattctggttattcctgaaaccacctaattcagccctagacttcccagtgtatgtgaatagtaaatcctcatttttttcttgagctaaaaggatttgggtttctgttacttgcaaaatgagtcttgagtaataca

SEQ ID NO: 2966 - DNA, 1244 bp, Artificial Sequence
  Synthetic polypeptide
atgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaaggactctcagaggctccacaaccctggcccaggatggactcatgacctggactgggctgatggtggtcaccatccccttgatgacagtgattggtggacacatgtactaatcagaatcattccccgacatacagacattgggacacccaaagatttttttttcctgctaaggttattcaactgggaccatgcaaataaacggtaagctgctagtgaccatctttctcagccactttgaagaagccctgcagcaggaaagaatgaggaaaatcagggctggacgatgaaaaaagagtggctcctgatatcatgatttgagccctttattctggttattcctgaaaccacctaattcagccctagacttcccagtgtatgtgaatagtaaatcctcatttttttcttgagctaaaaggatttgggtttctgttacttgcaaaatgagtcttgagtaataca

SEQ ID NO: 2967 - DNA, 605 bp, Artificial Sequence
  Synthetic polypeptide
atgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaaggactctcagaggctccacaaccctggcccaggatggactcatgacctggactgggctgatggtggtcaccatccccttgatgacagtgattggtggacacatgtactaatcagaatcattccccgacatacagacattgggacacccaaagatttttttttcctgctaaggttattcaactgggaccatgcaaataaacggtaagctgctagtgaccatctttctcagccactttgaagaagccctgcagcaggaaagaatgaggaaaatcagggctggacgatgaaaaaagagtggctcctgatatcatgatttgagccctttattctggttattcctgaaaccacctaattcagccctagacttcccagtgtatgtgaatagtaaatcctcatttttttcttgagctaaaaggatttgggtttctgttacttgcaaaatgagtcttgagtaataca

SEQ ID NO: 2968 - DNA, 558 bp, Artificial Sequence; identical to SEQ ID NO: 2797
  Synthetic polypeptide

SEQ ID NO: 2969 - DNA, 732 bp, Artificial Sequence
  Synthetic polypeptide
atggcgccggcgcagcgctgccctctgtgccgccagaccttcttctgtggtcgcgggcacgtttacagccgcaagcaccagcggcagctgaaggaggctttggagaggctcctgccccaggtggaggcggcccgcaaggccatccgcgccgctcaggtggagcgctatgtgcccgaacacgagcgatgctgctggtgcctgtgctgcggctgtgaggtgcgggaacacctgagccatggaaacctgacggtgctgtacggggggctgctggagcatctggccagcccagagcacaagaaagcaaccaacaaattctggtgggagaacaaagctgaggtccagatgaaagagaagtttctggtcactccccaggattatgcgcgattcaagaaatccatggtgaaaggtttggattcctatgaagaaaaggaggataaagtgatcaaggagatggcagctcagatccgtgaggtggagcagagccgacaggaggtggttcggtctgtcttagagcctcaggcagtgccagacccagaagagggctcttcagcacctagaagctggaaagggatgaacagccaagtagcttccagcttacagcagccctcaaatttggacctgccaccagctccagagcttgactggatggagacaggaccatctctgacattcattggccatcaggatgaagacagaattattgatacgtacgacacagatgaatctcagaag

SEQ ID NO: 2970 - DNA, 3665 bp, Artificial Sequence
  Synthetic polypeptide
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtgcacttcataaagcctgtaaaatttttagtaaaattcgaagtggtaagatttatgtgaatgatcttccagtgatcctttgcatcttgagaatttctataagtgatttagaaatgcgacaggcactaaagactgttgatattgatgcattccaggatgccttgaagattttctgtaggataaaaggtggtcgagtttcaactgatgacgtgtttgctgttttggatagcatgggtatccctataaaccgtgaaattttagaagaagtgacaaaacatacctatattgacagtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2971 - DNA, 3377 bp, Artificial Sequence
  Synthetic polypeptide
atggaaactaaagtacatttattctgccaggcagaggaaaatattgacttattagatgatggctctaattcttttgcaactgacttgtcatcaggaactattaaccacaagaaatacatcaagttttctaaaacaatagagaaggaaatttcaccggaaattaggagtttgagcccagaatataaaaaaatatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaattactcgggaaaaggaaatgctgtctaacctctacatgacattatatgatgaagtaacccatggatatttacactcaaaagaattaagtggtaaccacatggtggatattggggatattatatttactttgaatgagctacaggaacagtatgaggatgtttcaattacagaaggatcacctttgaatgaaattacttcagacagaaagttatcaagtgtagcaggatgctatctaaaatataagaagaaaaatagtttgtcttccaaactccctgaaccttcaatatccaaaaagttaaataaaaaaagcaaccaatattatagcaaaattatggagaatgatgaccttgaatctaaaagaccaaaaaatacttggcaaataagaaaatttctgggtggggttggcagcagtaatgtaggagtccaagaaccatattcaaagaatggcataaactttaaaaaacattcagagaagggtgaaattcatgactcaaagtctaaaccacaaagcttgaagagtagtacaagcctcagtaagtctctggataaaagtgatatttctagtatcccaaaacttcagaagccagctgtaagaaagcattccagtctccaaaaacaggtttcgtctacggaaaaaactgcaattagtactctggaaaacttctgtgaagctatcagtaaacttcaagaaaattacattgcagcagaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2972 - DNA, 2243 bp, Artificial Sequence
  Synthetic polypeptide
gaagaacttcagtctattttgccttcaacaggaattaatttattagatgaagaattccagaagattgtgacagacactagtagaaatgagaatggaatggtggagttagatgactttgtaaatgctctcgccaaggagcgaagttttcctgaatgcaatgcgttgcctggtgtcattaaagccattgataaaattaaagataaaaatgtggattatgaggatctaaatacttgtcttcaaaattttggtatttacctttctaagccagaatttaagaagatcacagaactgactgaagctggtgaaacaaaaaaagtgaattttaaagaattcattgatactatgatgagcaacacggaatgcttctctgaaaaattagtattgcctgatgctattgaaaccctcgacgatctcagaaaggagacgatgagtgtttctgacctgtggaatactctgtctagtttgaatagtaatttaaaaaaggatgaatttctagctgcattggaactagtgacagttgatgcctgccaagtgcctgcaattgcaggcgcgcgccgccacgcctgactggttttcgtatttttttggtggagacggggtttcgctgtgttggccgggctggtctccagctcctagccgcgagtgatccgccagcctcggcctcccggggtgccgggattgcagacggagtctggttcactcagtgctcaatggtgcccaggctggagtgcagtggcatgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgctcagtctggaaagtgaggagcatctctgcccggccgccatcccatctaggaagtgaggagcgcctcttcccggccgccatcctatctaggaagtgaggagcgtctctgcccggccgcccatcgtctgagatgtggggagagcctctaccccgccgccccgcctgggatgtgaggagcgcctctacccggccgcgaccccatctgggaggtgaggagcgtctctgcccggccgccccgtctgagaagtgaggagaccctccgcctggcaaccgcccgtctgagaagtgaggagcccctccgcccggcagctgccccgtctgagaagtgaagagcccctccacccggcagtcaccccgtctgggaagtgaggagcgtctccacccagcagccaccccatccgggagggaggtgggggtcagcccccgctaggccagccgccccgtccgggagggaggtgggggggtcagccccccgcccggccagccgccccgtccgggagggaggtggggggatcagcccctgcccggccagccgctccgtccgggagggaggttggggggtcagcccgccgcccggccagccgccccgtccgggagggaggtgggggggtcagcccccccctggccagccaccccgtctgggaggtgaggggcgcctctgcccagccgcccctactgggaagtgaggagcccctctgcccggccagccgccccgtccgggagggaggtgggggggtcagccccccgcccggccagccaccccgcccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaatcatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagtgtcctctgcctaggaaaaccagagacctttgttcacttgtttatctgctgaccttgcctccactattgtcctatgaccgtgccaaatccccctctgcgagaaacacccaagaataatcaataa

SEQ ID NO: 2973 - DNA, 950 bp, Artificial Sequence; identical to SEQ ID NO: 325
  Synthetic polypeptide

SEQ ID NO: 2974 - DNA, 637 bp, Artificial Sequence; identical to SEQ ID NO: 324
  Synthetic polypeptide

SEQ ID NO: 2975 - DNA, 235 bp, Artificial Sequence; identical to SEQ ID NO: 1657
  Synthetic polypeptide

SEQ ID NO: 2976 - DNA, 1078 bp, Artificial Sequence; identical to SEQ ID NO: 1658
  Synthetic polypeptide

SEQ ID NO: 2977 - DNA, 609 bp, Artificial Sequence; identical to SEQ ID NO: 249
  Synthetic polypeptide

SEQ ID NO: 2978 - DNA, 738 bp, Artificial Sequence; identical to SEQ ID NO: 250
  Synthetic polypeptide

SEQ ID NO: 2979 - DNA, 537 bp, Artificial Sequence; identical to SEQ ID NO: 251
  Synthetic polypeptide

SEQ ID NO: 2980 - DNA, 684 bp, Artificial Sequence; identical to SEQ ID NO: 253
  Synthetic polypeptide

SEQ ID NO: 2981 - DNA, 285 bp, Artificial Sequence; identical to SEQ ID NO: 255
  Synthetic polypeptide

SEQ ID NO: 2982 - DNA, 552 bp, Artificial Sequence; identical to SEQ ID NO: 254
  Synthetic polypeptide

SEQ ID NO: 2983 - DNA, 124 bp, Artificial Sequence
  Synthetic polypeptide
atggacacaagtcccctgtgtttctccattctgttggttttatgcatctttatccaatcaagtgcccttggacaaagcctgaaaccagagagccagttgctgagtatccaccaatgcaccactg

SEQ ID NO: 2984 - DNA, 645 bp, Artificial Sequence; identical to SEQ ID NO: 137
  Synthetic polypeptide

SEQ ID NO: 2985 - DNA, 1329 bp, Artificial Sequence
  Synthetic polypeptide
atgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacagctattcaggaggctaaggcacaagaatcacttgaacctgggaggtggaggttgcagtgagccgagatcgcagcactgcactccagcctgggtgacagagcaagaccctgcttcagaaaaaaaaaaaaaaaaaaaaaaa

SEQ ID NO: 2986 - DNA, 588 bp, Artificial Sequence
  Synthetic polypeptide
tcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacagctattcaggaggctaaggcacaagaatcacttgaacctgggaggtggaggttgcagtgagccgagatcgcagcactgcactccagcctgggtgacagagcaagaccctgcttcagaaaaaaaaaaaaaaaaaaaaaaa

SEQ ID NO: 2987 - DNA, 446 bp, Artificial Sequence; identical to SEQ ID NO: 2206
  Synthetic polypeptide

SEQ ID NO: 2988 - DNA, 229 bp, Artificial Sequence; identical to SEQ ID NO: 2209
  Synthetic polypeptide

SEQ ID NO: 2989 - DNA, 802 bp, Artificial Sequence; identical to SEQ ID NO: 2212
  Synthetic polypeptide

SEQ ID NO: 2990 - DNA, 2141 bp, Artificial Sequence; identical to SEQ ID NO: 2213
  Synthetic polypeptide

SEQ ID NO: 2991 - DNA, 2192 bp, Artificial Sequence; identical to SEQ ID NO: 2214
  Synthetic polypeptide

SEQ ID NO: 2992 - DNA, 2015 bp, Artificial Sequence; identical to SEQ ID NO: 2215
  Synthetic polypeptide

SEQ ID NO: 2993 - DNA, 206 bp, Artificial Sequence; identical to SEQ ID NO: 2207
  Synthetic polypeptide

SEQ ID NO: 2994 - DNA, 244 bp, Artificial Sequence; identical to SEQ ID NO: 2208
  Synthetic polypeptide

SEQ ID NO: 2995 - DNA, 499 bp, Artificial Sequence; identical to SEQ ID NO: 2210
  Synthetic polypeptide

SEQ ID NO: 2996 - DNA, 137 bp, Artificial Sequence
  Synthetic polypeptide
atggcagagccagaccgaggaggaggatcgcttgagcccaggaatttgaggctgcagtgagctatgatcgcactattgcactccaacctgggtgacatgagcgagaccctttctctaaaaagtaaaaaagaaagaaa

SEQ ID NO: 2997 - DNA, 669 bp, Artificial Sequence; identical to SEQ ID NO: 1845
  Synthetic polypeptide

SEQ ID NO: 2998 - DNA, 238 bp, Artificial Sequence; identical to SEQ ID NO: 2234
  Synthetic polypeptide

SEQ ID NO: 2999 - DNA, 230 bp, Artificial Sequence; identical to SEQ ID NO: 2288
  Synthetic polypeptide

SEQ ID NO: 3000 - DNA, 235 bp, Artificial Sequence; identical to SEQ ID NO: 2289
  Synthetic polypeptide

SEQ ID NO: 3001 - DNA, 564 bp, Artificial Sequence; identical to SEQ ID NO: 2295
  Synthetic polypeptide

SEQ ID NO: 3002 - DNA, 504 bp, Artificial Sequence; identical to SEQ ID NO: 2293
  Synthetic polypeptide

SEQ ID NO: 3003 - DNA, 378 bp, Artificial Sequence; identical to SEQ ID NO: 2294
  Synthetic polypeptide

SEQ ID NO: 3004 - DNA, 596 bp, Artificial Sequence
  Synthetic polypeptide
atgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatcactgtttcttcaccggcaactgcatcggcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccggttgctgtgtcacctctctgaaccttattcttatctgggaaatggagatgccaccatctgacctgtatct

SEQ ID NO: 3005 - DNA, 2267 bp, Artificial Sequence; identical to SEQ ID NO: 2277
  Synthetic polypeptide

SEQ ID NO: 3006 - DNA, 2264 bp, Artificial Sequence; identical to SEQ ID NO: 2278
  Synthetic polypeptide

SEQ ID NO: 3007 - DNA, 731 bp, Artificial Sequence; identical to SEQ ID NO: 2279
  Synthetic polypeptide

SEQ ID NO: 3008 - DNA, 1565 bp, Artificial Sequence; identical to SEQ ID NO: 2280
  Synthetic polypeptide

SEQ ID NO: 3009 - DNA, 496 bp, Artificial Sequence; identical to SEQ ID NO: 2298
  Synthetic polypeptide

SEQ ID NO: 3010 - DNA, 480 bp, Artificial Sequence; identical to SEQ ID NO: 2228
  Synthetic polypeptide

SEQ ID NO: 3011 - DNA, 410 bp, Artificial Sequence; identical to SEQ ID NO: 2219
  Synthetic polypeptide

SEQ ID NO: 3012 - DNA, 392 bp, Artificial Sequence; identical to SEQ ID NO: 2220
  Synthetic polypeptide

SEQ ID NO: 3013 - DNA, 1770 bp, Artificial Sequence
  Synthetic polypeptide
atgcaggggggtgaaccagtgtccacaatgaaagtctcggagagcgaaggaaagctggagggccaggccacagcggtgaccccgaacaagaacagcagctgtggaggtggaatcagtagcagcagcagcagccgcggtggcagtgcaaaaggctggcagtacagtgatcacatggaaaatgtgtatggctatttaatgaagtataccaaccttgtcactgggtggcagtacaggttttttgttttaaacaatgaagctgggctgttggagtactttgtgaatgaacagtctagaaatcagaaacctagaggaactttgcagcttgcaggagctgtaatatcacccagtgatgaggattctcacaccttcactgtaaacgctgccagtggggaacaatataaactcagagctacagatgcaaaagagcgacagcactgggttagcagacttcagatatgtacacagcatcatactgaagctattggaaagaataatcctcctctgaagtcacggagcttctcacttgcatctagtagtaattctcctatatcgcagaggagaccaagtcaaaatgccatttctttttttaatgttggacattccaaactgcaatcactgagcaaaagaactaatttacctccagaccatcttgtggaagtcagagaaatgatgtctcatgctgaaggacaacaaagagacttaattagacgaattgaatgccttcctacttctggccatcttagttccttggaccaggatctcttaatgctcaaagctacttccatggcaactatgaactgcttaaatgactgctttcatattctccagttacagcatgcatcacatcagaagggctcattgccttcaggaacgacaatcgagtggttagaaccaaagatatctttatcaaaccactataaaaatggagctgaccagccctttgcaactgatcagagtaagccggtggcagtcccagaagagcagcctgttgcagaatctggactattagcgagggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtggtgcttcctacatttatcctagagaagcgttccttgctggaaatgtatgcagactttatgtctcatccagacctatttatagccatcactaatggagccacagctgaggacagaatgattcgctttgttgagtactaccttacctcatttcatgaaggccgtaagggagccattgctaaaaaaccatacaatcctatcattggagaaacatttcactgttcctggaagatgccaaaaagcgaggtagcatccagtgtttttagcagttcttccacccagggagtcacaaatcatgctcctttatcgggggagtctttgacccaggtgggatcagactgttacacagtcagatttgttgctgagcaggtttctcatcatcctccagtctcaggattttatgcagaatgtacagagaggaagatgtgtgtaaatgcgcatgtctggactaagagcaagttcttaggcatgtcaataggcgtgacaatggttggagaaggtacttgggagactgaggtggcaggatcacttgagctcaggaaattgaggcagcagtgagccatgatcgtgccactgtactccagcctgcatgacagaggagaaccttgtctcaaa

SEQ ID NO: 3014 - DNA, 1481 bp, Artificial Sequence; identical to SEQ ID NO: 2275
  Synthetic polypeptide

SEQ ID NO: 3015 - DNA, 1352 bp, Artificial Sequence; identical to SEQ ID NO: 2276
  Synthetic polypeptide

SEQ ID NO: 3016 - DNA, 3391 bp, Artificial Sequence; identical to SEQ ID NO: 2216
  Synthetic polypeptide

SEQ ID NO: 3017 - DNA, 1825 bp, Artificial Sequence; identical to SEQ ID NO: 1660
  Synthetic polypeptide

SEQ ID NO: 3018 - DNA, 1825 bp, Artificial Sequence; identical to SEQ ID NO: 1661
  Synthetic polypeptide

SEQ ID NO: 3019 - DNA, 653 bp, Artificial Sequence
  Synthetic polypeptide
atgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaa

SEQ ID NO: 3020 - DNA, 710 bp, Artificial Sequence
  Synthetic polypeptide
atgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctgatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaa

SEQ ID NO: 3021 - DNA, 320 bp, Artificial Sequence
  Synthetic polypeptide
atgagcagggggaaggttattagacttcatcggcggaagcaggacaacatatcagggaggccaaagcgggcggatcacctgaggtcgggagtttgagaccagcctgaccaacatggagaaaccccatctctactgaaaatccaaaatagccaggtgtggtggcgcatgcctgtaatcccagctacttgggaggctgaggcaggagaatcgcttgaacccgggaggcggaagttgccatgagctgagattgcgccagtgcactccagcctgggcaacaagagcaaaactccctctcaaaaaaaaaaaaaaaaaaaaaagaa

SEQ ID NO: 3022 - DNA, 2466 bp, Artificial Sequence; identical to SEQ ID NO: 1682
  Synthetic polypeptide

SEQ ID NO: 3023 - DNA, 1806 bp, Artificial Sequence; identical to SEQ ID NO: 1683
  Synthetic polypeptide

SEQ ID NO: 3024 - DNA, 2412 bp, Artificial Sequence; identical to SEQ ID NO: 1684
  Synthetic polypeptide

SEQ ID NO: 3025 - DNA, 2211 bp, Artificial Sequence; identical to SEQ ID NO: 1685
  Synthetic polypeptide

SEQ ID NO: 3026 - DNA, 364 bp, Artificial Sequence; identical to SEQ ID NO: 1686
  Synthetic polypeptide

SEQ ID NO: 3027 - DNA, 500 bp, Artificial Sequence; identical to SEQ ID NO: 919
  Synthetic polypeptide

SEQ ID NO: 3028 - DNA, 1236 bp, Artificial Sequence; identical to SEQ ID NO: 980
  Synthetic polypeptide

SEQ ID NO: 3029 - DNA, 1070 bp, Artificial Sequence
  Synthetic polypeptide
atgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcgctgtgctgggatgatacaacttgactcaactcttcagttgattgttccctactaacagcaccctggggttagtgttgctttggttgaaaggaag

SEQ ID NO: 3030 - DNA, 177 bp, Artificial Sequence; identical to SEQ ID NO: 1886
  Synthetic polypeptide

SEQ ID NO: 3031 - DNA, 1063 bp, Artificial Sequence; identical to SEQ ID NO: 2221
  Synthetic polypeptide

SEQ ID NO: 3032 - DNA, 394 bp, Artificial Sequence
  Synthetic polypeptide
atgtcgtacagacgagaactagagaaataccgtgacctggatgaagatgaaatccttggagccctaacagaggaagagctgaggaccctggaaaatgagctggatgagctggaccctgataatgcactgctgcctgcaggcctgaggcagaaggatcagaccaccaaggcgcccacgggcccctttaaaagagaggagctcttggatcacttggaaaagcaagcaaaggagtttaaggaccgagaagatctggtcccctacacaggggaaaaacgaggcctccttctgctgttctcaaactttccacctcaggacctttgcacatactccctatgcctggagtgctggtcctgctgcccagctccatgctgtcttcttcatggctggctcctcc

SEQ ID NO: 3033 - DNA, 1150 bp, Artificial Sequence; identical to SEQ ID NO: 2329
  Synthetic polypeptide

SEQ ID NO: 3034 - DNA, 1009 bp, Artificial Sequence; identical to SEQ ID NO: 2330
  Synthetic polypeptide

SEQ ID NO: 3035 - DNA, 993 bp, Artificial Sequence; identical to SEQ ID NO: 2244
  Synthetic polypeptide

SEQ ID NO: 3036 - DNA, 941 bp, Artificial Sequence; identical to SEQ ID NO: 2706
  Synthetic polypeptide

SEQ ID NO: 3037 - DNA, 913 bp, Artificial Sequence; identical to SEQ ID NO: 2707
  Synthetic polypeptide

SEQ ID NO: 3038 - DNA, 1306 bp, Artificial Sequence
  Synthetic polypeptide
atgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctgcatgtaaagaaggacatgtttgcttactcttcctccatgattgtaagtttcttgaggccccccagccctgtggaactgtgagtcaattaaacctctttcctttataaattacccagttttgggtatttcttcatagcagcatgagaacagactaataca

SEQ ID NO: 3039 - DNA, 977 bp, Artificial Sequence
  Synthetic polypeptide
atgaagcacatcccggtcctcgaggacgggccgtggaagaccgtgtgcgtgaaggagctgaacggccttaagaagctcaagcggaaaggcaaggagccggcgcggcgcgcgaacggctataaaactttccgactggacttggaagcgcccgagccccgcgccgtagccaccaacgggctgcgggacaggacccatcggctgcagccggtcccggtaccggtgccggtgccagtcccagtggcgccggccgttcccccaagagggggcacggacacagccggggagcgcgggggctctcgggcgcccgaggtctccgacgcgcggaaacgctgcttcgccctaggcgcagtggggccaggactccccacgccgccgccgccgccgcctcctgcgccccagagccaggcacctgggggcccagaggcacagcctttccgggagccgggtctgcgtcctcgcatcttgctgtgcgcaccgcccgcgcgccccgcgccgtcagcacccccagcaccgccagcgcccccggagtccactgtgcgccctgcgcccccgacgcgccccggggaaagttcctactcgtcaatttcacacgtaatttacaataaccaccaggattcctccgcgtcgcctaggaaacgaccgggcgaagcgactgccgcctcctccgagatcaaagccctgcagcagacccggaggctcctggcgaacgccagggagcggacgcgggtgcacaccatcagcgcagccttcgaggcgctcaggaagcaggtgccgtgctactcatatgggcagaagctgtccaaactggccatcctgaggatcgcctgtaactacatcctgtccctggcgcggctggctgaccttgactacagtgccgaccacagcaacctcagcttctccgagtgtgtgcagcgctgcacccgcaccctgcaggccgagggacgtgccaagaagcgcaaggttctgctaacagtggg

SEQ ID NO: 3040 - DNA, 600 bp, Artificial Sequence
  Synthetic polypeptide
gtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3041 - DNA, 720 bp, Artificial Sequence
  Synthetic polypeptide
cagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3042 - DNA, 788 bp, Artificial Sequence
  Synthetic polypeptide
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3043 - DNA, 1735 bp, Artificial Sequence
  Synthetic polypeptide
atgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacgctctcttctgctgggttctctgcctggataaaagattctacggctgaacagaatcgttcaaaaaccacggtcttggccaggcgcagtggctcacacctaaaatcccagcactttgggaggccgaagtgggcggatcacgaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3044 - DNA, 577 bp, Artificial Sequence
  Synthetic polypeptide
aatgtactcaagattgcccccgagtcagctatcaagttcatggcctatgaacagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3045 - DNA, 1594 bp, Artificial Sequence
  Synthetic polypeptide
atgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3046 - DNA, 882 bp, Artificial Sequence
  Synthetic polypeptide
tccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3047 - DNA, 877 bp, Artificial Sequence
  Synthetic polypeptide
atgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3048 - DNA, 896 bp, Artificial Sequence
  Synthetic polypeptide
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggaagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaataca

SEQ ID NO: 3049 - DNA, 319 bp, Artificial Sequence
  Synthetic polypeptide
atgtggcagccggccacggagcgcctgcaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatggtgagagattaaatttctgttgttttaagctacccagtttatggttatttgttacaacagccctaggtagctactaca

SEQ ID NO: 3050 - DNA, 1906 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3051 - DNA, 1900 bp, Artificial Sequence
  Synthetic polypeptide
atgtttcgacagttttatctctggacatgtttagcttcagggatcatcctgggctctctctttgaaatctgcttgggccagtatgatgatggctggaggtacatgtattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3052 - DNA, 1885 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3053 - DNA, 718 bp, Artificial Sequence
  Synthetic polypeptide
atgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3054 - DNA, 1774 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3055 - DNA, 1819 bp, Artificial Sequence
  Synthetic polypeptide
atgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacaggtcttaatttaaatgccgcttcctcaaagaagacttccatgatttcctcttctcaatgttacccctttattatcttggagcatcctgatttctccttcacagcacatttaaaaatttataattatatggttaaactatctgtttctctcacttaattataggctcaaatggaataaaattattgtcaatttttttgcatacttttcttctttttctatcactactgtatgcctaacaccttacacagtcccagcacattgacctttaataaatattatttgttaaatgaataaat

SEQ ID NO: 3056 - DNA, 217 bp, Artificial Sequence
  Synthetic polypeptide
atggccgggggtgctggcgccggtgcggacggcggtgctggtggcggcggcggcggaggcgacggcagcggtcccagcggcagcagcagcggcgggaggagcctccgggaaatctgcttttgttcatgcatgcagcagacttggagaagctgatttgtcaccacctccagtagtagagttccattagttcaaaccagtcaaatcatggcatttccct

SEQ ID NO: 3057 - DNA, 661 bp, Artificial Sequence; identical to SEQ ID NO: 2696
  Synthetic polypeptide

SEQ ID NO: 3058 - DNA, 786 bp, Artificial Sequence; identical to SEQ ID NO: 2697
  Synthetic polypeptide

SEQ ID NO: 3059 - DNA, 757 bp, Artificial Sequence; identical to SEQ ID NO: 2698
  Synthetic polypeptide

SEQ ID NO: 3060 - DNA, 432 bp, Artificial Sequence; identical to SEQ ID NO: 2699
  Synthetic polypeptide

SEQ ID NO: 3061 - DNA, 385 bp, Artificial Sequence; identical to SEQ ID NO: 2700
  Synthetic polypeptide

SEQ ID NO: 3062 - DNA, 5958 bp, Artificial Sequence; identical to SEQ ID NO: 2260
  Synthetic polypeptide

SEQ ID NO: 3063 - DNA, 5904 bp, Artificial Sequence; identical to SEQ ID NO: 2261
  Synthetic polypeptide

SEQ ID NO: 3064 - DNA, 4677 bp, Artificial Sequence; identical to SEQ ID NO: 2262
  Synthetic polypeptide

SEQ ID NO: 3065 - DNA, 6018 bp, Artificial Sequence; identical to SEQ ID NO: 2263
  Synthetic polypeptide

SEQ ID NO: 3066 - DNA, 6021 bp, Artificial Sequence; identical to SEQ ID NO: 2264
  Synthetic polypeptide

SEQ ID NO: 3067 - DNA, 628 bp, Artificial Sequence; identical to SEQ ID NO: 2222
  Synthetic polypeptide

SEQ ID NO: 3068 - DNA, 307 bp, Artificial Sequence
  Synthetic polypeptide
atgcagcacatttttgccttcttctgcaccggtttcctaggcgcggtagtaggtgccaatttccccaacaatatccagatcgggggattatttccaaaccagcagtcacaggaacatgctgcttttagatttgctttgtcgcaactcacagagcccccgaagctgctcccccagattgatattgtgaacatcagcgacagctttgagatgacctatagatttgtgcagattgaaggagatcaacttggaaagtgcttagcataaggcctggcatagagtaagtacccgataaatgagagctattatt

SEQ ID NO: 3069 - DNA, 100 bp, Artificial Sequence
  Synthetic polypeptide
atgacctatagatttgtgcagattgaaggagatcaacttggaaagtgcttagcataaggcctggcatagagtaagtacccgataaatgagagctattatt

SEQ ID NO: 3070 - DNA, 337 bp, Artificial Sequence
  Synthetic polypeptide
atgtgctgcagtacccatctctttcagcctctccagctagctggcggcttggagtggccatggagtaacttgctttgtttcctgacacctgttaagctacatcctgaagtgtggggattatttccaaaccagcagtcacaggaacatgctgcttttagatttgctttgtcgcaactcacagagcccccgaagctgctcccccagattgatattgtgaacatcagcgacagctttgagatgacctatagatttgtgcagattgaaggagatcaacttggaaagtgcttagcataaggcctggcatagagtaagtacccgataaatgagagctattatt

SEQ ID NO: 3071 - DNA, 645 bp, Artificial Sequence; identical to SEQ ID NO: 137
  Synthetic polypeptide

SEQ ID NO: 3072 - DNA, 2160 bp, Artificial Sequence
  Synthetic polypeptide
atggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgtggagacgcagttctcgatgcagatggacctgatccggcagcagcttgagttcgaggcccagcacatccgctcgctgatggaggagcgcttcggcacctcggacgagatggtgcagcgggcacagatccgcgcctcgcgcctggagcagattgacaaggagctgctggaggcgcaggaccgagtgcagcagacggagccccaggccttgctggcggtgaagtcggtgccggtggacgaggaccccgagacagaggtccccacacaccctgaggatggcacccctcagccgggcaacagcaaggtggaggtggtcttctggctgttgtccatgttggcgacgcgcgaccaggaggatacagcgcgcacgctgctggccatgtccagctcgcccgagagctgcgtggccatgcgccgctcgggctgtctgcctctgctgctgcaaatcctccacggcaccgaggccgcggccgggggtcgcgccggggccccaggggcaccgggcgccaaggacgcacgcatgcgcgccaacgcggcgctgcacaacatcgtcttctcgcagccggaccagggcctggcgcgcaaggagatgcgcgtcctgcacgtgctggagcagatccgggcctactgcgagacctgctgggactggctgcaggcccgagacggcgggcccgagggaggtggcgccggcagcgccccgatccccatcgagccgcagatctgccaggccacctgtgctgttatgaagctgtcctttgatgaggagtaccgccgtgccatgaacgagctaggtgggctgcaggccgtggcagagctgctgcaggttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggccaggtgcagtggctcatgcctgtaatcccagcactttgggaggccgaggcaggcagatcacctgaggttgggagttcaagaccagcctgaccaacatggagaaagcctgtccctactaaaaatataaaattagccaggtgtggtggcgggcacctgtaatcccagctactcgggaggctgaggcagaagaatcgtttgaacccaggaggcagaggttgcggtgagctgagattgtgccactgcactccagtctgggcaacaagagcgaaacttcatctcaaaaaaaaaaaaaaaaaaaaaaaaaa

SEQ ID NO: 3073 - DNA, 1338 bp, Artificial Sequence
  Synthetic polypeptide
atggcgagctccgtggcgccctacgagcagctggtgaggcaggtggaggccttgaaggctgagaacagccacctgaggcaggagctaagggacaactccagccacctgtccaagctggagacagagacgtcgggcatgaaggaggtcctgaagcacctacagggaaaactggagcaggaggcccgagtgctggtgtcctcggggcagacggaggtgctggagcagctgaaggccctacagatggacatcaccagcctgtacaacctcaagttccagccgcccaccctgggcccggagcctgccgcccggacccccgagggcagcccagtacacggctccgggccctccaaggacagctttggggagctgagccgggccaccatccggctgctggaggaactggaccgggaacggtgtttcctgctgaatgagattgagaaggaggagaaggagaagctctggtactactctcagctgcagggcctgtccaagcgcctggacgagctgccgcacgttgactatgagatgcacaagatgacccgggacccgctgaacctggcgctgcgccgctacgcgggcatgaccctcaccaacctcacctttggggacgttgccaacaaggccaccctgtgtgcgcgccgcggctgcatggaggccatcgtggcccagctggcctccgacagtgaggagctccaccaggtggtgtccagcatccttcggaacttgtcctggagggccgacatcaacagcaagaaggtgctgagggaggcgggcagcgtgactgccctggtgcagtgtgtcctgcgggccaccaaggagtccaccctgaagagcgtgctgagcgccctgtggaatctgtctgcacacagcacagagaacaaggcggccatctgccaggtggatggcgccctgggcttcctggtgagcaccctgacctacaagtgtcagagcaactcgctggccatcatcgagagcggcggcggcatcctccgcaatgtgtccagcctcgtcgccacccgtgaggactacaggccaggtgcagtggctcatgcctgtaatcccagcactttgggaggccgaggcaggcagatcacctgaggttgggagttcaagaccagcctgaccaacatggagaaagcctgtccctactaaaaatataaaattagccaggtgtggtggcgggcacctgtaatcccagctactcgggaggctgaggcagaagaatcgtttgaacccaggaggcagaggttgcggtgagctgagattgtgccactgcactccagtctgggcaacaagagcgaaacttcatctcaaaaaaaaaaaaaaaaaaaaaaaaaa

SEQ ID NO: 3074 - DNA, 2849 bp, Artificial Sequence; identical to SEQ ID NO: 1326
  Synthetic polypeptide

SEQ ID NO: 3075 - DNA, 1925 bp, Artificial Sequence; identical to SEQ ID NO: 1327
  Synthetic polypeptide

SEQ ID NO: 3076 - DNA, 2729 bp, Artificial Sequence; identical to SEQ ID NO: 1328
  Synthetic polypeptide

SEQ ID NO: 3077 - DNA, 2549 bp, Artificial Sequence; identical to SEQ ID NO: 1329
  Synthetic polypeptide

SEQ ID NO: 3078 - DNA, 1065 bp, Artificial Sequence
  Synthetic polypeptide
atggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagaa

SEQ ID NO: 3079 - DNA, 3057 bp, Artificial Sequence
  Synthetic polypeptide
atgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtgaatggacagctgctcccttagac

SEQ ID NO: 3080 - DNA, 3024 bp, Artificial Sequence
  Synthetic polypeptide
atgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaacctcctcatcttcatctatgatgaggtccgaaagctcatcctgcggcggtatcctggtgaatggacagctgctcccttagac

SEQ ID NO: 3081 - DNA, 2138 bp, Artificial Sequence
  Synthetic polypeptide
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtgaatggacagctgctcccttagac

SEQ ID NO: 3082 - DNA, 3608 bp, Artificial Sequence
  Synthetic polypeptide
atgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgccccactattcacaatagccaaggtgggaacatccaaaatacccatcaacagatgaaggaagagacaaaatgtggtccatccatgcaatggaatattgttcggccataaaggagaa

SEQ ID NO: 3083 - DNA, 1961 bp, Artificial Sequence
  Synthetic polypeptide
atgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgccccactattcacaatagccaaggtgggaacatccaaaatacccatcaacagatgaaggaagagacaaaatgtggtccatccatgcaatggaatattgttcggccataaaggagaa

SEQ ID NO: 3084 - DNA, 352 bp, Artificial Sequence
  Synthetic polypeptide
agggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgccccactattcacaatagccaaggtgggaacatccaaaatacccatcaacagatgaaggaagagacaaaatgtggtccatccatgcaatggaatattgttcggccataaaggagaa

SEQ ID NO: 3085 - DNA, 1030 bp, Artificial Sequence; identical to SEQ ID NO: 2232
  Synthetic polypeptide

SEQ ID NO: 3086 - DNA, 1204 bp, Artificial Sequence; identical to SEQ ID NO: 2233
  Synthetic polypeptide

SEQ ID NO: 3087 - DNA, 519 bp, Artificial Sequence
  Synthetic polypeptide
atggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcctcaatcttcccagccctaaaacaggggtctgga

SEQ ID NO: 3088 - DNA, 522 bp, Artificial Sequence
  Synthetic polypeptide
atgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcctcaatcttcccagccctaaaacaggggtctgga

SEQ ID NO: 3089 - DNA, 353 bp, Artificial Sequence; identical to SEQ ID NO: 2268
  Synthetic polypeptide

SEQ ID NO: 3090 - DNA, 340 bp, Artificial Sequence; identical to SEQ ID NO: 2269
  Synthetic polypeptide

SEQ ID NO: 3091 - DNA, 362 bp, Artificial Sequence; identical to SEQ ID NO: 2270
  Synthetic polypeptide

SEQ ID NO: 3092 - DNA, 550 bp, Artificial Sequence
  Synthetic polypeptide
atggagccgctcagccaccggggcctgccgcgcctgtcctggatcgacaccctctacagcaacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctgggggtgcggtggctcacacctgtaatcccagcactttgggaggccaaggcgggcggatcacgaggtcaggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaaaaaaagaaaaaataaa

SEQ ID NO: 3093 - DNA, 412 bp, Artificial Sequence
  Synthetic polypeptide
atgccgtacatcgatgagtcgcccaccatgtccccgcagctcagcgcccgcagccagggcgggggggatggcgtctccccgactccacctgagggactggctcctgggggtgcggtggctcacacctgtaatcccagcactttgggaggccaaggcgggcggatcacgaggtcaggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaaaaaaagaaaaaataaa

SEQ ID NO: 3094 - DNA, 4120 bp, Artificial Sequence; identical to SEQ ID NO: 1356
  Synthetic polypeptide

SEQ ID NO: 3095 - DNA, 4132 bp, Artificial Sequence; identical to SEQ ID NO: 1357
  Synthetic polypeptide

SEQ ID NO: 3096 - DNA, 4120 bp, Artificial Sequence; identical to SEQ ID NO: 1358
  Synthetic polypeptide

SEQ ID NO: 3097 - DNA, 4024 bp, Artificial Sequence; identical to SEQ ID NO: 1359
  Synthetic polypeptide

SEQ ID NO: 3098 - DNA, 4531 bp, Artificial Sequence; identical to SEQ ID NO: 1360
  Synthetic polypeptide

SEQ ID NO: 3099 - DNA, 4054 bp, Artificial Sequence; identical to SEQ ID NO: 1361
  Synthetic polypeptide

SEQ ID NO: 3100 - DNA, 4078 bp, Artificial Sequence; identical to SEQ ID NO: 1362
  Synthetic polypeptide

SEQ ID NO: 3101 - DNA, 4201 bp, Artificial Sequence; identical to SEQ ID NO: 1363
  Synthetic polypeptide

SEQ ID NO: 3102 - DNA, 4189 bp, Artificial Sequence; identical to SEQ ID NO: 1364
  Synthetic polypeptide

SEQ ID NO: 3103 - DNA, 210 bp, Artificial Sequence; identical to SEQ ID NO: 1365
  Synthetic polypeptide

SEQ ID NO: 3104 - DNA, 970 bp, Artificial Sequence
  Synthetic polypeptide
atgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagctactcaggaggtggaggcaggagaatcacttgaaccttggaggcggaggctgcagtgagccgggagtgcgccacggcacttcagcctgggcgacagagcgagactctgtctcaaaagagaaaa

SEQ ID NO: 3105 - DNA, 871 bp, Artificial Sequence
  Synthetic polypeptide
atgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagctactcaggaggtggaggcaggagaatcacttgaaccttggaggcggaggctgcagtgagccgggagtgcgccacggcacttcagcctgggcgacagagcgagactctgtctcaaaagagaaaa

SEQ ID NO: 3106 - DNA, 628 bp, Artificial Sequence
  Synthetic polypeptide
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcaacggagcaagactccacctcaaaaataaataaataaataaatgaataaaaaataaaaataaaaaataaa

SEQ ID NO: 3107 - DNA, 412 bp, Artificial Sequence
  Synthetic polypeptide
atggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcaacggagcaagactccacctcaaaaataaataaataaataaatgaataaaaaataaaaataaaaaataaa

SEQ ID NO: 3108 - DNA, 571 bp, Artificial Sequence
  Synthetic polypeptide
atggccaagcgcagctcgctgtacatccgcatcgtggaggggaagaaccttcccgccaaggacatgacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcaacggagcaagactccacctcaaaaataaataaataaataaatgaataaaaaataaaaataaaaaataaa

SEQ ID NO: 3109 - DNA, 268 bp, Artificial Sequence
  Synthetic polypeptide
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcgaa

SEQ ID NO: 3110 - DNA, 215 bp, Artificial Sequence
  Synthetic polypeptide
gggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaa

SEQ ID NO: 3111 - DNA, 173 bp, Artificial Sequence
  Synthetic polypeptide
atgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgaa

SEQ ID NO: 3112 - DNA, 212 bp, Artificial Sequence
  Synthetic polypeptide
ccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaa

SEQ ID NO: 3113 - DNA, 3220 bp, Artificial Sequence; identical to SEQ ID NO: 248
  Synthetic polypeptide

SEQ ID NO: 3114 - DNA, 98 bp, Artificial Sequence
  Synthetic polypeptide
atgaaacttctttacctgtttcttgccatccttctggccatagaagaaccagtgatatcaggattgcagtaaggatgaaatgacataataatgcaaag

SEQ ID NO: 3115 - DNA, 628 bp, Artificial Sequence
  Synthetic polypeptide
atggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcagcggagcaagactccacctcaaaaataaataaataaataaatgaataaaaaataaaaataaaaaataaa

SEQ ID NO: 3116 - DNA, 412 bp, Artificial Sequence
  Synthetic polypeptide
atggatgaggatgccctcagccgggacgacgttatcggaaaggtctgccttacaagggacaccatagcctctcaccctaagggccgggcacggtggctcacacctgtaatcccagcactttgggaggccgagacgggtggatcacgaggtcaggagatcgagaccatcctggctaacacggtgaaaccccgtctctactaaaagtacaaaaaaattagctgggcgtggtggcaggcacctgtagtcctagctacttggcaggctgaagcaggagaatggcgtgaacctgggaggcagagcttgcagtaagccgagatcgcgccactgcactccagcctcagcagcggagcaagactccacctcaaaaataaataaataaataaatgaataaaaaataaaaataaaaaataaa

SEQ ID NO: 3117 - DNA, 212 bp, Artificial Sequence
  Synthetic polypeptide
atgaacaagaagaagaaaccgttcctagggatgcccgcgcccctcggctacgtgccggggctgggccgggggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagagga

SEQ ID NO: 3118 - DNA, 1898 bp, Artificial Sequence; identical to SEQ ID NO: 2282
  Synthetic polypeptide

SEQ ID NO: 3119 - DNA, 1865 bp, Artificial Sequence; identical to SEQ ID NO: 2283
  Synthetic polypeptide

SEQ ID NO: 3120 - DNA, 764 bp, Artificial Sequence; identical to SEQ ID NO: 2284
  Synthetic polypeptide

SEQ ID NO: 3121 - DNA, 978 bp, Artificial Sequence; identical to SEQ ID NO: 2267
  Synthetic polypeptide

SEQ ID NO: 3122 - DNA, 1109 bp, Artificial Sequence
  Synthetic polypeptide
atgggccgggcccggcgcttccagtggccgctgctgctgctgtgggcggccgcggcggggccaggggcaggacaggaagtacagacagagaacgtgacagtggctgagggtggggtggctgagatcacctgccgtctgcaccagtatgatgggtccatagttgtcatccagaacccagcccggcagaccctcttcttcaatggcacccgtgccttgaaggatgagcgtttccagcttgaggagttctccccacgccgggtgcggatccggctctcagatgcccgcctggaggacgaggggggctatttctgccagctctacacagaagacacccaccaccagattgccacgctcacggtactagtggccccagagaatcctgtggtggaggtccgggagcaggcggtagagggcggcgaggtggagctcagctgcctcgttccgcggtcccgtccggctgccaccctgcgctggtaccgggaccgcaaggagctgaaaggagtgagcagcagccaggaaaatggcaaggtctggagcgtggcaagcacagtacggtttcgtgtggaccgtaaggacgacggtggtatcatcatctgtgaggcgcagaaccaggcgctgccctccggacacagcaagcagacgcagtacgtgctggatgtgcagtactcccccacggcccggattcatgcctcccaagctgtggtgagggagggagacacgctggtgttgacgtgtgctgtcacggggaaccccaggccaaaccagatccgctggaaccgcgggaatgagtctttgccggagagggcggaggccgtgggagagacgctcacgctgccgggtctggtatccgcggataacggcacctacacttgcgaggcgtccaataagcacggccatgcgagggcgctctacgtacttgtggtctacgactggcccgcggggctcaaattcgggttggctgcattctattgcaggtaaccgaacctgtctgcgcctcagtttacccatcagtaaagtggaaataaacaatagcacctatataacaaggctgttgtgaagattatgtgaactaaatatgtaaggtggttggaatgggctctagcacacag

SEQ ID NO: 3123 - DNA, 2397 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3124 - DNA, 2391 bp, Artificial Sequence
  Synthetic polypeptide
atgtttcgacagttttatctctggacatgtttagcttcagggatcatcctgggctctctctttgaaatctgcttgggccagtatgatgatggctggaggtacatgtattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3125 - DNA, 2376 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3126 - DNA, 1209 bp, Artificial Sequence
  Synthetic polypeptide
atgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3127 - DNA, 2265 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3128 - DNA, 2310 bp, Artificial Sequence
  Synthetic polypeptide
atgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3129 - DNA, 2163 bp, Artificial Sequence
  Synthetic polypeptide
atgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagctcatagacggaaggaactagctgtgtctgagataagacttcggacttcaactgttgagttaatgctgaaatgagttaagattttgggtggcttttggaaggcatgattggttttgaaatgtgaggacatgggatttgggaggggctggggatgg

SEQ ID NO: 3130 - DNA, 404 bp, Artificial Sequence
  Synthetic polypeptide
atggggaccaccgaagccacgctccggatggaaaacgtggacgtgaaggaggaatggcaggacgaagatcttcccaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagaacgtggctttcatcagaatctcaaaggcgaccaagatcccaacaa

SEQ ID NO: 3131 - DNA, 422 bp, Artificial Sequence
  Synthetic polypeptide
atggcaggacgaagatcttcccagccaggaattgctttgcacaatcctgggaaccaccaagtccaaaatccacagggcaggctggaaactgtcaggccactcccagaagagacgggggtggaactgcttggcagcccggtggaagacacatcctctcctcccaacacgctaaatttcaacggagcgcatcgtaagaggaagacgctggtggccccagagatcaacatttctctggatcagagtgaggggtccctgctgtccgatgacttcttggatacccctgatgacctggatattaacgtggatgacatcgagacccccgatgagaccgactcgctggagttcctggggaatggcaacgaactggagtgggaagaacgtggctttcatcagaatctcaaaggcgaccaagatcccaacaa

SEQ ID NO: 3132 - DNA, 2927 bp, Artificial Sequence
  Synthetic polypeptide
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagagggatg

SEQ ID NO: 3133 - DNA, 2930 bp, Artificial Sequence
  Synthetic polypeptide
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagagggatg

SEQ ID NO: 3134 - DNA, 175 bp, Artificial Sequence
  Synthetic polypeptide
actgtgatgactcattcaccccccaggagaagctgtggcagcagctcagaagaggacgggagtggaggaggagaaagtaaagaaaagcaaggaaggagggagaatgaaaaagtgctgggaggaagaaggagaaacgagagagaagaggtggagaacaggacagaaaaagaggaga

SEQ ID NO: 3135 - DNA, 1289 bp, Artificial Sequence
  Synthetic polypeptide
atggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagaacggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacgggagtggaggaggagaaagtaaagaaaagcaaggaaggagggagaatgaaaaagtgctgggaggaagaaggagaaacgagagagaagaggtggagaacaggacagaaaaagaggaga

SEQ ID NO: 3136 - DNA, 18530 bp, Artificial Sequence
  Synthetic polypeptide
atgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagagcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttgacagtactcgatgacgaggtaccagaaaatgatgaaatatttttaattcaactgaaaagtgtagaaggaggagctgagattaacacctctaggaattccattgagatcatcattaagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtgttgacacggaacagcactgatccctcaccagtaacagcagatatcagaccgagctctggagttctccattttgcacaagggcagatgttggcaacaattcctcttactgtggttgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtgaacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagacagggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaggaaggtgagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaacaggtgatacagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggttccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtttgccaccaatgatagattttttactggttggaattttccccaccaccgtgcatttacaacagcacatgcggcgtcaccacagtggaacggatgctttgtactttaccggactagagggtgcatttgggactgttaatccaaaataccatccctccaggaataatacaattgccaactttacattctcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataactgcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttactgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgagggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcaggcaaattatgtaatttctctgaaatgaggatagcactacttactttacaaggcacctatggaaatcaaccaaagaatgtgaaatttccagcacttaac

SEQ ID NO: 3137 - DNA, 5513 bp, Artificial Sequence
  Synthetic polypeptide
atgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggagaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctggtggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtggttgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcaggcaaattatgtaatttctctgaaatgaggatagcactacttactttacaaggcacctatggaaatcaaccaaagaatgtgaaatttccagcacttaac

SEQ ID NO: 3138 - DNA, 520 bp, Artificial Sequence; identical to SEQ ID NO: 1727
  Synthetic polypeptide

SEQ ID NO: 3139 - DNA, 403 bp, Artificial Sequence; identical to SEQ ID NO: 2317
  Synthetic polypeptide

SEQ ID NO: 3140 - DNA, 688 bp, Artificial Sequence; identical to SEQ ID NO: 2318
  Synthetic polypeptide

SEQ ID NO: 3141 - DNA, 757 bp, Artificial Sequence; identical to SEQ ID NO: 2319
  Synthetic polypeptide

SEQ ID NO: 3142 - DNA, 547 bp, Artificial Sequence; identical to SEQ ID NO: 2320
  Synthetic polypeptide

SEQ ID NO: 3143 - DNA, 256 bp, Artificial Sequence; identical to SEQ ID NO: 2321
  Synthetic polypeptide

SEQ ID NO: 3144 - DNA, 622 bp, Artificial Sequence; identical to SEQ ID NO: 2322
  Synthetic polypeptide

SEQ ID NO: 3145 - DNA, 343 bp, Artificial Sequence; identical to SEQ ID NO: 2323
  Synthetic polypeptide

SEQ ID NO: 3146 - DNA, 511 bp, Artificial Sequence
  Synthetic polypeptide
atggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagagcttcctcttct

SEQ ID NO: 3147 - DNA, 1004 bp, Artificial Sequence
  Synthetic polypeptide
atgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggcttcatttcttgagctgtaaaatgcaagggtggctctaaa

SEQ ID NO: 3148 - DNA, 646 bp, Artificial Sequence
  Synthetic polypeptide
atgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggacagctgaggttgcaggggcaccagatggcctgaacgcaggacagtcaggtgcctccagggagagacaggactctggatcactgagccccctggggtccattgcacaagcgagtaaggaatcagctaaaagtcttaagtgattgctaaaggccaactaagactcacgtgagtgcatagaaccttcagaagccacagagacaacatggatcctaccaacatgcagacctttttccctgcggactgggtccctgcagggtcctgaagaaagcttccctggaaggggcaagactggaggaag

SEQ ID NO: 3149 - DNA, 571 bp, Artificial Sequence
  Synthetic polypeptide
atgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttcttcttctctcccagctgaacccgaggctaaagaagatgaggcaagagaaaatgtaccccaaggacagctgaggttgcaggggcaccagatggcctgaacgcaggacagtcaggtgcctccagggagagacaggactctggatcactgagccccctggggtccattgcacaagcgagtaaggaatcagctaaaagtcttaagtgattgctaaaggccaactaagactcacgtgagtgcatagaaccttcagaagccacagagacaacatggatcctaccaacatgcagacctttttccctgcggactgggtccctgcagggtcctgaagaaagcttccctggaaggggcaagactggaggaag

SEQ ID NO: 3150 - DNA, 718 bp, Artificial Sequence; identical to SEQ ID NO: 1366
  Synthetic polypeptide

SEQ ID NO: 3151 - DNA, 281 bp, Artificial Sequence
  Synthetic polypeptide
atgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccaggactgaaagaggtaacg

SEQ ID NO: 3152 - DNA, 2671 bp, Artificial Sequence
  Synthetic polypeptide
atgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcctcccagccaagaagtttctgctgtcctaagcctcccggtttgtggtcctttgtcaagggcagccctagga

SEQ ID NO: 3153 - DNA, 1990 bp, Artificial Sequence
  Synthetic polypeptide
atggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcctcccagccaagaagtttctgctgtcctaagcctcccggtttgtggtcctttgtcaagggcagccctagga

SEQ ID NO: 3154 - DNA, 262 bp, Artificial Sequence
  Synthetic polypeptide
atgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcctcccagccaagaagtttctgctgtcctaagcctcccggtttgtggtcctttgtcaagggcagccctagga

SEQ ID NO: 3155 - DNA, 1563 bp, Artificial Sequence; identical to SEQ ID NO: 2008
  Synthetic polypeptide

SEQ ID NO: 3156 - DNA, 569 bp, Artificial Sequence
  Synthetic polypeptide
atgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3157 - DNA, 833 bp, Artificial Sequence
  Synthetic polypeptide
atggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3158 - DNA, 647 bp, Artificial Sequence
  Synthetic polypeptide
atggcgggcctggaggtactgttcgcatcggcagcgccggccatcacctgcaggcaggacgcgctcgtctgcttcttgcattgggaagtggtgacacacggttacttcggcttgggtgtcggtgaccagccgggtcccaatgataagaagtcagaactgctgccagctgggtggaacaacaataaagacctgtatgtcctccggtatgagtataaggatgggtccagaaagctccttgtgaaagccatcaccgtggagagcagcatgatcctcaatgtgctggaatatggctcacagcaagtggcagacttgaccctgaacttggatgattatatcgatgcagaacacctgggtgacttccacaggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3159 - DNA, 357 bp, Artificial Sequence
  Synthetic polypeptide
tatccatgagcagtgggaaaaggctaatgtaagcagtccccaccgggagttcccccctgctaccgccagagaggtggacccactccggattcctccacaccacccacacaccagtcggcagcctccctggcctcggagaggtggcatgattgtggatcccctgagatctggcttcccaagagcacttattgacccttcctcaggcctcccgaaccgacttcctccaggcgctgtgcccccaggagctcgctttgacccctttggacccattgggaccagcccacccggggccggagttaagatgagtccagcgaagtgcctagagtaccaaattcatggagacgtttcctctttggg

SEQ ID NO: 3160 - DNA, 553 bp, Artificial Sequence
  Synthetic polypeptide
atgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaaaaaatttgccaactcatg

SEQ ID NO: 3161 - DNA, 2607 bp, Artificial Sequence
  Synthetic polypeptide
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaa

SEQ ID NO: 3162 - DNA, 2379 bp, Artificial Sequence
  Synthetic polypeptide
atgaagattattttcccgattctaagtaatccagtcttcaggcgcaccgttaaactcctgctctgtttactgtggattggatattctcaaggaaccacacatgtattaagatttggtggtatttttgaatatgtggaatctggcccaatgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaa

SEQ ID NO: 3163 - DNA, 2460 bp, Artificial Sequence
  Synthetic polypeptide
atgggagctgaggaacttgcattcagatttgctgtgaacacaattaacagaaacagaacattgctacccaatactacccttacctatgatacccagaagataaacctttatgatagttttgaagcatccaagaaagcctgtgatcagctgtctcttggggtggctgccatcttcgggccttcacacagctcatcagcaaacgcagtgcagtccatctgcaatgctctgggagttccccacatacagacccgctggaagcaccaggtgtcagacaacaaagattccttctatgtcagtctctacccagacttctcttcactcagccgtgccattttagacctggtgcagtttttcaagtggaaaaccgtcacggttgtgtatgatgacagcactggtctcattcgtttgcaagagctcatcaaagctccatcaaggtataatcttcgactcaaaattcgtcagttacctgctgatacaaaggatgcaaaacccttactaaaagaaatgaaaagaggcaaggagtttcatgtaatctttgattgtagccatgaaatggcagcaggcattttaaaacaggcattagctatgggaatgatgacagaatactatcattatatctttaccactctggacctctttgctcttgatgttgagccctaccgatacagtggtgttaacatgacagggttcagaatattaaatacagaaaatacccaagtctcctccatcattgaaaagtggtcgatggaacgattgcaggcacctccgaaacccgattcaggtttgctggatggatttatgacgactgatgctgctctaatgtatgatgctgtgcatgtggtgtctgtggccgttcaacagtttccccagatgacagtcagttccttgcagtgtaatcgacataaaccctggcgcttcgggacccgctttatgagtctaattaaagaggcacattgggaaggcctcacaggcagaataactttcaacaaaaccaatggcttgagaacagattttgatttggatgtgatcagtctgaaggaagaaggtctagaaaagattggaacgtgggatccagccagtggcctgaatatgacagaaagtcaaaagggaaagccagcgaacatcacagattccttatccaatcgttctttgattgttaccaccattttggaagagccttatgtcctttttaagaagtctgacaaacctctctatggtaatgatcgatttgaaggctattgcattgatctcctcagagagttatctacaatccttggctttacatatgaaattagacttgtggaagatgggaaatatggagcccaggatgatgccaatggacaatggaatggaatggttcgtgaactaattgatcataaagctgaccttgcagttgctccactggctattacctatgttcgagagaaggtcatcgacttttccaagccctttatgacacttggaataagtattttgtaccgcaagcccaatggtacaaacccaggcgtcttctccttcctgaatcctctctcccctgatatctggatgtatattctgctggcttacttgggtgtcagttgtgtgctctttgtcatagccaggtttagtccttatgagtggtataatccacacccttgcaaccctgactcagacgtggtggaaaacaattttaccttgctaaatagtttctggtttggagttggagctctcatgcagcaaggttctgagctcatgcccaaagcactgtccaccaggatagtgggaggcatttggtggtttttcacacttatcatcatttcttcgtatactgctaacttagccgcctttctgacagtggaacgcatggaatcccctattgactctgctgatgatttagctaaacaaaccaagatagaatatggagcagtagaggatggtgcaaccatgacttttttcaagaaatcaaaaatctccacgtatgacaaaatgtgggcctttatgagtagcagaaggcagtcagtgctggtcaaaagtaatgaagaaggaatccagcgagtcctcacctctgattatgctttcctaatggagtcaacaaccatcgagtttgttacccagcggaactgtaacctgacacagattggcggccttatagactctaaaggttatggcgttggcactcccatgggttcggtggcttatgcctgtaatctcagtactttgggaggccgagctggatggatcacaaggtcaggagttcgagaccagcctggccaacatggtgaaaccccatctctactaaaaatacaaaaaattagctgggcatggtggtgtgagcctgtaatcccagctactcaggagggtgaggcaggagaattgctttaacccaggaggcagaggttgcagtgagccaagatcacaccaatgcaccccagcctgggtggcagagcaagactccatctcaaagaaaaaagaaaaaaaaaa

SEQ ID NO: 3164 - DNA, 7 bp, Artificial Sequence
  Synthetic polypeptide
atgggtc

SEQ ID NO: 3165 - DNA, 555 bp, Artificial Sequence
  Synthetic polypeptide
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttcttatgattttctt

SEQ ID NO: 3166 - DNA, 189 bp, Artificial Sequence
  Synthetic polypeptide
atgcaggtttgcagccagccccaaagggggtgtgtgcgcgagcagagcgctataaatacggcgcctcccagtgcccacaacgcggcgtcgccaggaggagcgcgcgggcacagggtgccgctgaccggtccgtgagtaagtggagtattacatagccataaaagtatgcccttaaagaatatttgaaga

SEQ ID NO: 3167 - DNA, 2492 bp, Artificial Sequence
  Synthetic polypeptide
atgtggctggtaactttcctcctgctcctggactctttacacaaagcccgccctgaagatgttggcaccagcctctactttgtaaatgactccttgcagcagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctgggcgtggtggcgcatgcctgtagttccagctaatcaggaggctgaggcaggagaatcgcttgaacctgggaggcagagcttgctgtgagccaagatcgcaccactgcactccagcctgggcgacagaggaagactccatctcaaaaaaaaaaaaaatgcagaaaaa

SEQ ID NO: 3168 - DNA, 3302 bp, Artificial Sequence
  Synthetic polypeptide
atgacaggagccggggagccgaggagggaggagccgccgccgcagccgagcgctgggctgaggagcagagagagcggggcgccgagtgcgggcggctgggagcgcgctgagcgggggagaggcgctgccgcacggccggccacaggaccacctccccggagaatagggcctctttatggcatgtggctggtaactttcctcctgctcctggactctttacacaaagcccgccctgaagatgttggcaccagcctctactttgtaaatgactccttgcagcaggtgaccttttccagctccgtgggggtggtggtgccctgcccggccgcgggctcccccagcgcggcccttcgatggtacctggccacaggggacgacatctacgacgtgccgcacatccggcacgtccacgccaacgggacgctgcagctctaccccttctccccctccgccttcaatagctttatccacgacaatgactacttctgcaccgcggagaacgctgccggcaagatccggagccccaacatccgcgtcaaagcagttttcagggaaccctacaccgtccgggtggaggatcaaaggtcaatgcgtggcaacgtggccgtcttcaagtgcctcatcccctcttcagtgcaggaatatgttagcgttgtatcttgggagaaagacacagtctccatcatcccagaacacaggttttttattacctaccacggcgggctgtacatctctgacgtacagaaggaggacgccctctccacctatcgctgcatcaccaagcacaagtatagcggggagacccggcagagcaatggggcacgcctctctgtgacagaccctgctgagtcgatccccaccatcctggatggcttccactcccaggaagtgtgggccggccacaccgtggagctgccctgcaccgcctcgggctaccctatccccgccatccgctggctcaaggatggccggcccctcccggctgacagccgctggaccaagcgcatcacagggctgaccatcagcgacttgcggaccgaggacagcggcacctacatttgtgaggtcaccaacaccttcggttcggcagaggccacaggcatcctcatggtcattgatccccttcatgtgaccctgacaccaaagaagctgaagaccggcattggcagcacggtcatcctctcctgtgccctgacgggctccccagagttcaccatccgctggtatcgcaacacggagctggtgctgcctgacgaggccatctccatccgcgggctcagcaacgagacgctgctcatcacctcggcccagaagagccattccggggcctaccagtgcttcgctacccgcaaggcccagaccgcccaggactttgccatcattgcacttgaggatggcacgccccgcatcgtctcgtccttcagcgagaaggtggtcaaccccggggagcagttctcactgatgtgtgcggccaagggcgccccgccccccacggtcacctgggccctcgacgatgagcccatcgtgcgggatggcagccaccgcaccaaccagtacaccatgtcggacggcaccaccatcagccacatgaacgtcacaggcccccagatccgcgacgggggcgtgtaccggtgcacagcgcggaacttggtgggcagtgctgaatatcaggcgcgaataaacgtaagaggcccacccagcatccgggctatgcggaacatcacagcagtcgccgggcgggacacccttatcaactgcagggtcatcggctatccctactactccatcaagtggtacaaggatgccctgctgctgccagacaaccaccgccaggtggtgtttgagaatgggaccctcaagctgactgacgtgcagaagggcatggatgagggggagtacctgtgcagtgtcctcatccagccccagctctccatcagccagagcgttcacgtagccgtcaaagtgccccctctgatccagcccttcgaattcccacccgcctccatcggccagctgctctacattccctgtgtggtgtcctcgggggacatgcccatccgtatcacctggaggaaggacggacaggtgatcatctcaggctcgggcgtgaccatcgagagcaaggaattcatgagctccctgcagatctctagcgtctccctcaagcacaacggcaactatacatgcatcgccagcaacgcagccgccaccgtgagccgggagcgccagctcatcgtgcgtgtgccccctcgatttgtggtgcaacccaacaaccaggatggcatctacggcaaagctggtgtgctcaactgctcggtggacggctaccccccacccaaggtcatgtggaagcatgccaaggggagcgggaacccccagcagtaccaccctgtgcccctcactggccgcatccagatcctgcccaacagctcgctgctgatccgccacgtcctagaagaggacatcggctactacctctgccaggccagcaacggcgtaggcaccgacatcagcaagtccatgttcctcacagtcaagatcccggccatgatcacttcccaccccaacaccaccatcgccatcaagggccatgcgaaggagctaaactgcacggcacggggtgagcggcccatcatcatccgctgggagaagggggacacagtcatcgaccctgaccgcgtcatgcggtatgccatcgccaccaaggacaacggcgacgaggtcgtctccacactgaagctcaagcccgctgaccgtggggactctgtgttcttcagctgccatgccatcaactcgtatggggaggaccggggcttgatccaactcactgtgcaagagccccccgaccccccagagctggagatccgggaggtgaaggcccggagcatgaacctgcgctggacccagcgattcgacgggaacagcatcatcacgggcttcgacattgaatacaagaacaaatcagattcctgggacttcaagcagtccacacgcaacatctcccccaccatcaaccaggccaacattgtggacttgcacccggcatctgtgtacagcatccgcatgtactctttcaacaagattggccgcagtgaaccaagcaaggagctcaccatcagcactgaggaggccgctgggcgtggtggcgcatgcctgtagttccagctaatcaggaggctgaggcaggagaatcgcttgaacctgggaggcagagcttgctgtgagccaagatcgcaccactgcactccagcctgggcgacagaggaagactccatctcaaaaaaaaaaaaaatgcagaaaaa

SEQ ID NO: 3169 - DNA, 1071 bp, Artificial Sequence; identical to SEQ ID NO: 2257
  Synthetic polypeptide

SEQ ID NO: 3170 - DNA, 1122 bp, Artificial Sequence; identical to SEQ ID NO: 2258
  Synthetic polypeptide

SEQ ID NO: 3171 - DNA, 3733 bp, Artificial Sequence; identical to SEQ ID NO: 2382
  Synthetic polypeptide

SEQ ID NO: 3172 - DNA, 2086 bp, Artificial Sequence; identical to SEQ ID NO: 2383
  Synthetic polypeptide

SEQ ID NO: 3173 - DNA, 477 bp, Artificial Sequence; identical to SEQ ID NO: 2384
  Synthetic polypeptide

SEQ ID NO: 3174 - DNA, 382 bp, Artificial Sequence; identical to SEQ ID NO: 2783
  Synthetic polypeptide

SEQ ID NO: 3175 - DNA, 475 bp, Artificial Sequence; identical to SEQ ID NO: 2784
  Synthetic polypeptide

SEQ ID NO: 3176 - DNA, 511 bp, Artificial Sequence; identical to SEQ ID NO: 2785
  Synthetic polypeptide

SEQ ID NO: 3177 - DNA, 1673 bp, Artificial Sequence; identical to SEQ ID NO: 2326
  Synthetic polypeptide

SEQ ID NO: 3178 - DNA, 3049 bp, Artificial Sequence
  Synthetic polypeptide
atgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagcaaaagccaagagcgcatatcatgacgtggtgatcggatgctgattcacagttctgtctggaagccatggatagttctaattaattttaaatggggaaatgtattcaatacttattcacaaatgtagcttgagagacaaacaattaaatgtggcctttacagaagaaaataaggaggtccttagtgagtgaaaatttggaaatcactg

SEQ ID NO: 3179 - DNA, 2130 bp, Artificial Sequence
  Synthetic polypeptide
tccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagcaaaagccaagagcgcatatcatgacgtggtgatcggatgctgattcacagttctgtctggaagccatggatagttctaattaattttaaatggggaaatgtattcaatacttattcacaaatgtagcttgagagacaaacaattaaatgtggcctttacagaagaaaataaggaggtccttagtgagtgaaaatttggaaatcactg

SEQ ID NO: 3180 - DNA, 484 bp, Artificial Sequence
  Synthetic polypeptide
atgggcgagcaccccagcccgggccccgcggtggccgcctgcgccgaggcggagcgcatcgaggagctggaacccgaggccgaggagcggctgcccgcggcgccggaggaccactggaaagtcctgtttgatcagtttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctagaagccttccttgacctctgacctccctgggactggattgggctccctcttgtgtgctcccacagcaaccatcactctgaactgtgattgctggttactaatctgtcttgagcaccaccgtatccctccctgtgcctggtaatgagcctgacacttagtagttgctcagtaaattgtgatggatggatga

SEQ ID NO: 3181 - DNA, 460 bp, Artificial Sequence
  Synthetic polypeptide
atgggcgagcaccccagcccgggccccgcggtggccgcctgcgccgaggcggagcgcatcgaggagctggaacccgaggccgaggagcggctgcccgcggcgccggaggactttgaccctgggaacacaggctacattagcacaggcaagttccggagtcttctggagagccacagctccaagctggacccgcacaaaagggaggtcctcctggctcttgccgacagccacgcggatgggcagatcggctaccaggattttgtcagcctagaagccttccttgacctctgacctccctgggactggattgggctccctcttgtgtgctcccacagcaaccatcactctgaactgtgattgctggttactaatctgtcttgagcaccaccgtatccctccctgtgcctggtaatgagcctgacacttagtagttgctcagtaaattgtgatggatggatga

SEQ ID NO: 3182 - DNA, 634 bp, Artificial Sequence
  Synthetic polypeptide
atgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgcatagaggtcaaaagcatggaaactggagttaaaagatgtggatttgaagcctggctgtgacacttacggactgtgtgacctggagaattaatcttcctatgctttagttgctcatctgcaaatatgcatataattgtacctgtcaggagactgttgcaaagactaaatgagctaatgtattatttagtgtctggtttacagtaagtaggccctctgtgagtgttgggtat

SEQ ID NO: 3183 - DNA, 676 bp, Artificial Sequence
  Synthetic polypeptide
atgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgcatagaggtcaaaagcatggaaactggagttaaaagatgtggatttgaagcctggctgtgacacttacggactgtgtgacctggagaattaatcttcctatgctttagttgctcatctgcaaatatgcatataattgtacctgtcaggagactgttgcaaagactaaatgagctaatgtattatttagtgtctggtttacagtaagtaggccctctgtgagtgttgggtat

SEQ ID NO: 3184 - DNA, 1380 bp, Artificial Sequence
  Synthetic polypeptide
atgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggattattcacagtagccaagatgtgcaatcaaattaagtgtccatcaacagatgaatggataaagaatatgtatcacatatgcatcatggaatactattcagccttaaaaaagagaaaatcctgtcatttgccacaacttgaatgaacctggaggacattatgctaagtgaagtaagccaggcacagaaagacaaacgctgcacgatctcacttctatgtggaatctaaaaaagttgaacgaagtagagcagaatggtggttaccagaggctggggcaggggggttgttgagagatattggtcaaagggtacaaattttcagtctgactagaggaacaagttcaagaggtctactgtaaaacatggcgatagtgactacagtcaataacaatgtattgtattcttgaaaatcactgagagagtagattttaagtgttcttaccacaaaaacataagtgtgtgaggtaatgcacatgtcacttagctcaatttaactattccaaaatttatacatatctcagaacccggtgttgtacatgataaatatatacaaattttatttgtcaattaaaaaataa

SEQ ID NO: 3185 - DNA, 332 bp, Artificial Sequence
  Synthetic polypeptide
atgagcatcccactgctcctccaggacaaggtggccctcgtggagcgctatgtggccggcttcccggacctccagaggaggctgctggtcctcatggattcctggtgccagcccggctttgacatcaaggacgttgccagacaaaaatttcaagagaataagaggggagacgggagctggaacccggaagacagatgtccaggcagcgactgtcctcggaggcctgagagtgctgaacctgcaaatgcaaggagccagttggcttcggagcccccgggaggcacaggaagtggaggcccagattcctccaagaagctgggctggaaacaggg

SEQ ID NO: 3186 - DNA, 848 bp, Artificial Sequence
  Synthetic polypeptide
atggacccaggagatcccgctggtgaccctgccgctggcgagcgccaccgcatgggccgggaccccctcctgctcctgcaggccctgcagaccctgtggtccacgcgggagcggaagcagctccgggaggaagcctggcgggggtttgctgccttggacgaccccctggccgggcttctggacatgctggagagctgccggggccagcggggagagggcccctccctggcggcctggatctcccaccagctgcagtgctggctacaggcacagccatgcccgagcctggcccagcacagcctgaggctgaagcagctgcaggcccgagcggtcaaagtcctcactgagagcccccccagccttgcggcaccactggccagcatcttccagctgcaggatgcagacaggagctgcctgctggcacacgtccaccgcctccaccacgagggcaggttcagagaagcagccacgctgggcgcgacgttgaagctgcagtcggagcttggcgttgaaaagatgagcatcccactgctcctccaggacaaggtggccctcgtggagcgctatgtggccggcttcccggacctccagaggaggctgctggtcctcatggattcctggtgccagcccggctttgacatcaaggacgttgccagacaaaaatttcaagagaataagaggggagacgggagctggaacccggaagacagatgtccaggcagcgactgtcctcggaggcctgagagtgctgaacctgcaaatgcaaggagccagttggcttcggagcccccgggaggcacaggaagtggaggcccagattcctccaagaagctgggctggaaacaggg

SEQ ID NO: 3187 - DNA, 241 bp, Artificial Sequence
  Synthetic polypeptide
tcatggattcctggtgccagcccggctttgacatcaaggacgttgccagacaaaaatttcaagagaataagaggggagacgggagctggaacccggaagacagatgtccaggcagcgactgtcctcggaggcctgagagtgctgaacctgcaaatgcaaggagccagttggcttcggagcccccgggaggcacaggaagtggaggcccagattcctccaagaagctgggctggaaacaggg

SEQ ID NO: 3188 - DNA, 1206 bp, Artificial Sequence; identical to SEQ ID NO: 282
  Synthetic polypeptide

SEQ ID NO: 3189 - DNA, 1209 bp, Artificial Sequence; identical to SEQ ID NO: 281
  Synthetic polypeptide

SEQ ID NO: 3190 - DNA, 1203 bp, Artificial Sequence; identical to SEQ ID NO: 286
  Synthetic polypeptide

SEQ ID NO: 3191 - DNA, 678 bp, Artificial Sequence
  Synthetic polypeptide
atgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgaaccaacagcatcagcattacctgggagctcaccagaaatgcagaatctcaggccccaccccagacctacttgacctaagtctacatttaatgaggtcccggatggttcaagggcatatggacaccggagaggcactg

SEQ ID NO: 3192 - DNA, 165 bp, Artificial Sequence
  Synthetic polypeptide
gctctgcccgaggtgcggcacccactgaaccaacagcatcagcattacctgggagctcaccagaaatgcagaatctcaggccccaccccagacctacttgacctaagtctacatttaatgaggtcccggatggttcaagggcatatggacaccggagaggcactg

SEQ ID NO: 3193 - DNA, 2206 bp, Artificial Sequence
  Synthetic polypeptide
atggcaaccccggcggcggtcaaccctccggaaatggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacgtatcagagcttttattacaccaataaggactggatttctaggaggtaggcaaagtgtgccttgtttcccaaacttatttgtccacagaattcttttctcacagagtatcacatgggctgagaattcaacagaacacatgttggggaa

SEQ ID NO: 3194 - DNA, 2173 bp, Artificial Sequence
  Synthetic polypeptide
atggcttcagacatacctggatctgtgacgttgcccgttgcccccatggcggccaccggacaggtgaggatggcgggggccatgcctgcccgtggaggaaagcggcgttccggaatggacttcgatgatgaagatggtgaaggccccagtaaattttcaagagagaatcatagtgaaatcgaaaggcgcagacggaacaagatgactcagtacatcacggagctctccgacatggtccccacatgcagcgcactggctcggaagccagacaagctcaccatcctccgcatggccgtctcgcacatgaagtccatgaggggtacagggaacaagtccaccgatggcgcgtacaagccttccttcctcacagagcaggaactgaagcatctcatccttgaagcagctgatggatttctgtttgtggtggctgctgagacagggcgagtgatttatgtgtctgactccgtcacccctgttctgaaccagccccagtcagagtggtttgggagcacactgtatgaacaggtgcatcctgatgacgtggagaagctgagagagcaactgtgcacctcagaaaactcaatgacaggccggatcttggacctgaagactgggacggtcaagaaagaagggcagcagtcatccatgaggatgtgcatgggctcgcggcggtctttcatctgcaggatgaggtgtggaaatgctcctttggaccaccttcctctaaacagaataaccaccatgaggaaaaggttcaggaatggccttggccctgtgaaagaaggagaagcccaatatgctgtggtccactgtacaggatacatcaaggcctggccaccagcaggaatgaccatacctgaagaagacgctgatgtgggacaaggcagtaaatattgcctcgtggcaattgggagactccaggtgaccagctctcctgtatgcatggacatgaatgggatgtcggtgcccacagagttcttatcccggcataactccgatggaatcatcacatttgtggatccaagatgtatcagtgtgattggctaccaaccccaggatcttctgggaaaggacattttggaattctgccaccctgaggatcaaagccatctgcgtgagagcttccagcaggtggttaagctgaaaggccaagtcctgtcggtcatgtatcgatttcgcaccaagaaccgggagtggatgttgatccgcaccagcagcttcacattccagaatccctattctgatgagattgagtacatcatctgcaccaacaccaacgtcaagcaacttcagcaacagcaggcagaattggaagtgcaccagagagatggattgtcatcgtatgacttatcccaggtccccgtccccaacctaccagccggtgttcatgaggccgggaagtccgtggaaaaggcggatgcaatcttctcccaggaaagagatcctcggtttgctgaaatgtttgcaggaattagtgcatcggagaagaagatgatgagctcagcctctgcagcaggaacccagcagatctactcccaaggaagcccatttccctctggacactccgggaaggccttcagctcttcagtggttcatgtgcctggagtgaatgatattcagtcctcttcttccacgggccagaacatgtcccaaatctcccggcagctaaaccagagtcaggtggcatggacagggagtcgtccgccctttccgggacagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcgctgaaagtggacaaagtagcgggcagttccaagggcggccctcggaagtctggtcgcagtggcaaagccagcaccatggccagcagagcggtgagcagcactcccaccagcagcccggtcagactgaagtgttccaggacgtatcagagcttttattacaccaataaggactggatttctaggaggtaggcaaagtgtgccttgtttcccaaacttatttgtccacagaattcttttctcacagagtatcacatgggctgagaattcaacagaacacatgttggggaa

SEQ ID NO: 3195 - DNA, 1041 bp, Artificial Sequence; identical to SEQ ID NO: 969
  Synthetic polypeptide

SEQ ID NO: 3196 - DNA, 451 bp, Artificial Sequence; identical to SEQ ID NO: 339
  Synthetic polypeptide

SEQ ID NO: 3197 - DNA, 1025 bp, Artificial Sequence
  Synthetic polypeptide
atgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggacatgccttacaagaagtactaaaaggagttattcaacctaaaggaaaag

SEQ ID NO: 3198 - DNA, 316 bp, Artificial Sequence
  Synthetic polypeptide
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3199 - DNA, 263 bp, Artificial Sequence
  Synthetic polypeptide
gggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3200 - DNA, 221 bp, Artificial Sequence
  Synthetic polypeptide
atgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3201 - DNA, 260 bp, Artificial Sequence
  Synthetic polypeptide
ccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcggtggagcgtttgtgggagaatccaggaaggggcctcattcctgtctgggt

SEQ ID NO: 3202 - DNA, 565 bp, Artificial Sequence; identical to SEQ ID NO: 1420
  Synthetic polypeptide

SEQ ID NO: 3203 - DNA, 12492 bp, Artificial Sequence
  Synthetic polypeptide
atgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaacagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3204 - DNA, 12567 bp, Artificial Sequence
  Synthetic polypeptide
atgttggaaggccttgtagcctgggttctcaatacctatttgggaaaatatgtcaataacctgaacactgaccagctctcagttgcacttctcaaaggtgctgttgaattagaaaacttgccattaaagaaagatgccttgaaagaattggaattaccatttgaagtcaaagctggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaagaatgaccgccagcagaaaggggagtcctattggtattcagttaccgcctccgtagttacaaggattgtggagaatattgaattaaaaattcaagatgtccatttacgctttgaagatggtgtcaccaatccctcccatccttttgcttttggcatctgcattaagaatgtgtccatgcaaaatgctgtgaatgagcctgtacagaaactaatgcggaaaaagcaattagacgtagcagaatttagcatctattgggatgtcgattgcactttactgggggatttgcctcagatggagttacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcagctgcaataccggcaaatcatggaattcctcaaggagctggaacgaaaggagaggcaggtgaagttccgaaggtggaaacccaaggtggcgatatctaagaactgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggaggaaatgtgtcggattgaagaggaacagagctttgaggaattgaagattttgcgtgaactggttcatgatcgatttcacaaacaggaagaactagcagagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcagatgtaaaacttctagcagagtctcttcctcgaagaaattcctcgttgctttcagtccggttgggtggactgtttcttcgagacctggctacagaaggaactatgtttcctcttctagtcttccctaatccacaaaaagaagttggcagagtctcacaatcttttggtctacaaactacatctgcagacagaagtgatcattacccagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttttggttatcagtctgaacttgagctgagagtggctgaagctgcccgaagacaatataacaagctgaagatgcagaccaaggcagaaatccggcaaactcttgatcgtttgctagtgggtgatttcattgaggagagtaaacgatggaccgtgcggctggatatttctgcccctcaggtgatatttcctgatgatttcaaattcaagaatcctgtgttagttgtcgtggatctaggaagaatgcttttgacgaacacccaagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagcagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3205 - DNA, 9032 bp, Artificial Sequence
  Synthetic polypeptide
ttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggttcattcactttctctagtgctgaataagaccaccagtgagcttgccaaagcaaatgtgtccaaattagtagcacacctggaaatgattgagggagacctggccttacagggcagcattgggagtctgtctctaagtgacctcacatgccatggagagttctacagagaacggttcactaccagtggtgaagaagcactcatcttccagacttttaaatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaaagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatactgtcctgagtggagaagtgtacacctgtatgtgcttcctcattgatatggtgaatgtaagtctggagcttaaagatccaaaaagaaaagaaggtgctgggtccctagccagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtacggagtttgtggtcattgaagatgtgtcctgcttcgacaccaatgccattattctgaaaggcaccacagtgctcacctataagccccggtttgttgatcgccccttttcaggaagtttgtttggcattgaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtctgaattttcttcagcgtgtaagaactagccctgaaggctatgcccacttcaccctttctggagattattataaccgtgctctttcaggctgggagccatttattgagccttggccatgctctgtatcctggcaacagcaggcagctagtcgtctccatcctcctcgactgaagctagaagccaaggccaaacctcgtttggatatcaatatcacttctgtgctaattgaccagtatgtaagtaccaaggaatcgtggatggcagattactgtaaagatgacaaggacatagagtcagctaaatcagaagactggatgggctcttcggtggatcctccatgttttggacaaagcctcccccttgtctaccttagaactaggagtacagccagtctgactaacctagagcaccagatctatgctagagaggtgaaaacccccaagcgccggcagccatttgtcccctttgctctgaggaaccacacggggtgcactttgtggtttgccaccctgaccaccacacccaccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcattttaaaaaagaaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacagatacgagccactgatgctgagaaagcctgaccgcaggcgaagcacaactcagacgtggagtttccgagaaggaaaactgacctgtgggttacatgggttggtcgtccaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccagataacagatttctgccaccggaaaagcagccgttcatatgaagtggatgaacttcctgtcaccgaacaagagctgcagaaattaaagaatccagatacagagcaggaattggaagtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaagcatctgatgatcacagctcagagattcacagtgcaaattgaggagaaactgctcctcaagctgctaagtttctttggctacgatcaagcagaatcagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3206 - DNA, 561 bp, Artificial Sequence
  Synthetic polypeptide
atgagaggagagaaactcagtaaggccctaaaaagcaccttggggtttcctttgatacggtttgaagacgctgtgattaatctagatccattcactcgggtacatccctatgagaccaaggagttcatcatcaatgatatcctcaaacatttccaggaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctg

SEQ ID NO: 3207 - DNA, 621 bp, Artificial Sequence
  Synthetic polypeptide
atgcacggctcctgcagtttcctgatgcttctgctgccgctactgctactgctggtggccaccacaggccccgttggagccctcacagatgaggagaaacgtttgatggtggagctgcacaacctctaccgggcccaggtatccccgacggcctcagacatgctgcacatgcacaatcctggttcaggtttctttcattcttccacacaaggactcctaggatagcctctacctgttccccagcttctggcctctgctgtcagaatgaataatccaacacatgggcctgaccctgctcaaaatccttcagtggctcccatggctccctactgcttcaggttaaagctccagctcctgactgagaaggttctgtgtgttctggcccctgcctatctctccatcctcctctcccgcttgccctttattcttctgtcacctgaacagcttgtcttttcccagccaaaatgtttcccagcttcatgcctttgctgatgtgtaccttctgattaggatgcctctcccctccagctgactaatgcctcatcttttaacacttagcttggtgtctccctctccacctttggctgggctagatggccctctttggtgcctctatagtac

SEQ ID NO: 3208 - DNA, 1426 bp, Artificial Sequence; identical to SEQ ID NO: 1626
  Synthetic polypeptide

SEQ ID NO: 3209 - DNA, 721 bp, Artificial Sequence
  Synthetic polypeptide
atgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggaggacgaagtgggaggatcactcaaggccagcagtttaggactaacctggacatcatagcaagaccctgtctctacaaacaatataaaaactagctgagcatggtggtgtgcacctgtagtcctggctactctggaggctgaggtagggagcatctcttagcccaggaattcaaggctgcagtgagctatgattgggccactgcatttcagcctgggtgacacagggagaccc

SEQ ID NO: 3210 - DNA, 1728 bp, Artificial Sequence; identical to SEQ ID NO: 2224
  Synthetic polypeptide

SEQ ID NO: 3211 - DNA, 1680 bp, Artificial Sequence; identical to SEQ ID NO: 2225
  Synthetic polypeptide

SEQ ID NO: 3212 - DNA, 1512 bp, Artificial Sequence; identical to SEQ ID NO: 2226
  Synthetic polypeptide

SEQ ID NO: 3213 - DNA, 5394 bp, Artificial Sequence
  Synthetic polypeptide
atggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3214 - DNA, 5259 bp, Artificial Sequence
  Synthetic polypeptide
atgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3215 - DNA, 5409 bp, Artificial Sequence
  Synthetic polypeptide
atgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3216 - DNA, 5403 bp, Artificial Sequence
  Synthetic polypeptide
atgcctggggagcagatggaccctactggaagtcagttggattcagatttctctcagcaagatactccttgcctgataattgaagattctcagcctgaaagccaggttctagaggatgattctggttctcacttcagtatgctatctcgacaccttcctaatctccagacgcacaaagaaaatcctgtgttggatgttgtgtccaatcctgaacaaacagctggagaagaacgaggagacggtaatagtgggttcaatgaacatttgaaagaaaacaaggttgcagaccctgtggattcttctaacttggacacatgtggttccatcagtcaggtcattgagcagttacctcagccaaacaggacaagcagtgttctgggaatgtcagtggaatctgctcctgctgtggaggaagagaagggagaagagttggaacagaaggagaaagagaaggaagaagatacttcaggcaatactacacattcccttggtgctgaagatactgcctcatcacagttgggttttggggttctggaactctcccagagccaggatgttgaggaaaatactgtgccatatgaagtggacaaagagcagctacaatcagtaaccaccaactctggttataccaggctgtctgatgtggatgctaatactgcaattaagcatgaagaacagtccaacgaagatatccccatagcagaacagtccagcaaggacatccctgtgacagcacagcccagtaaggatgtacatgttgtaaaagagcaaaatccaccacctgcaaggtcagaggacatgccttttagccccaaagcatctgttgctgctatggaagcaaaagaacagttgtctgcacaagaacttatggaaagtggactgcagattcagaagtcaccagagcctgaggttttgtcaactcaggaagacttgtttgaccagagcaataaaacagtatcttctgatggttgctctactccttcaagggaggaaggtgggtgttctttggcttccactcctgccaccactctgcatctcctgcagctctctggtcagaggtcccttgttcaggacagtctttccacgaattcttcagatcttgttgctccttctcctgatgctttccgatctactccttttatcgttcctagcagtcccacagagcaagaagggagacaagataagccaatggacacgtcagtgttatctgaagaaggaggagagccttttcagaagaaacttcaaagtggtgaaccagtggagttagaaaacccccctctcctgcctgagtccactgtatcaccacaagcctcaacaccaatatctcagagcacaccagtcttccctcctgggtcacttcctatcccatcccagcctcagttttctcatgacatttttattccttccccaagtctggaagaacaatcaaatgatgggaagaaagatggagatatgcatagttcatctttgacagttgagtgttctaaaacttcagagattgaaccaaagaattcccctgaggatcttgggctatctttgacaggggattcttgcaagttgatgctttctacaagtgaatatagtcagtccccaaagatggagagcttgagttctcacagaattgatgaagatggagaaaacacacagattgaggatacggaacccatgtctccagttctcaattctaaatttgttcctgctgaaaatgatagtatcctgatgaatccagcacaggatggtgaagtacaactgagtcagaatgatgacaaaacaaagggagatgatacagacaccagggatgacattagtattttagccactggttgcaagggcagagaagaaacggtagcagaagatgtttgtattgatctcacttgtgattcggggagtcaggcagttccgtcaccagctactcgatctgaggcactttctagtgtgttagatcaggaggaagctatggaaattaaagaacaccatccagaggaggggtcttcagggtctgaggtggaagaaatccctgagacaccttgtgaaagtcaaggagaggaactcaaagaagaaaatatggagagtgttccgttgcacctttctctgactgaaactcagtcccaagggttgtgtcttcaaaaggaaatgccaaaaaaagaatgctcagaagctatggaagttgaaaccagtgtgattagtattgattcccctcaaaagttggcaatacttgaccaagaattggaacataaggaacaggaagcttgggaagaagctacttcagaggactccagtgttgtcattgtagatgtgaaagagccatctcccagagttgatgtttcttgtgaacctttggagggagtggagaagtgctcagattcccagtcatgggaggatattgctccagaaatagaaccatgtgctgagaatagattagacaccaaggaagaaaagagtgtagaatatgaaggagatctgaaatcagggactgcagaaacagaacctgtagagcaagattcttcacagccttccttacctttagtgagagcagatgatcctttaagacttgaccaggagttgcagcagccccaaactcaggagaaaacaagtaattcattaacagaagactcaaaaatggctaatgcaaagcagctaagctcagatgcagaggcccagaagctggggaagccctctgcccatgcctcacaaagcttctgtgaaagttctagtgaaaccccatttcatttcactttgcctaaagaaggtgatatcatcccaccattgactggtgcaaccccacctcttattgggcacctaaaattggagcccaagagacacagtactcctattggtattagcaactatccagaaagcaccatagcaaccagtgatgtcatgtctgaaagcatggtggagacccatgatcccatacttgggagtggaaaaggggattctggggctgccccagacgtggatgataaattatgtctaagaatgaaactggttagtcctgagactgaggcgagtgaagagtctttgcagttcaacctggaaaagcctgcaactggtgaaagaaaaaatggatctactgctgttgctgagtctgttgccagtccccagaagaccatgtctgtgttgagctgtatctgtgaagccaggcaagagaatgaggctcgaagtgaggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctgtaggggcaggagagtttgtgagcccctgtgagagtggagacaacaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3217 - DNA, 272 bp, Artificial Sequence
  Synthetic polypeptide
acaccggtgaaccctctgccctggaagagcagagagggcctttgcctctcaacaagaccttgtttctgggctacgcatttctccttaccatggccacaaccagtgacaagttggccagccgctccaaactgccagatggtcctacaggaagcagtgaagaagaggaggatgacaagaaaacaagctcaaattagatatttggtcaaaagaagcaatttctaattgcctagggtcattacagcttcagcctcatctctcatatcttctacttc

SEQ ID NO: 3218 - DNA, 303 bp, Artificial Sequence; identical to SEQ ID NO: 148
  Synthetic polypeptide

SEQ ID NO: 3219 - DNA, 301 bp, Artificial Sequence; identical to SEQ ID NO: 147
  Synthetic polypeptide

SEQ ID NO: 3220 - DNA, 3174 bp, Artificial Sequence
  Synthetic polypeptide
atggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacatcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccataaggtctgactgcctgtagggtcaggcaaaaagagccatatttttcttcttgcagagagcctataaatgggtgtgcaagtaggagagatatcgctaaattcttttcctagcaagaaatattaatattaagaccttaggaaaataattgcatcccttgggggaggtctataaatggccactctgggagtgtctgtcttaagtggttgagataaagcctgaaataaggctctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtaaaattcctctctttgtactctttatttctcagaccagccaacacttagggaaaatagaaagaacctacgttgaaatattgggggcgggttcccccaata

SEQ ID NO: 3221 - DNA, 2751 bp, Artificial Sequence
  Synthetic polypeptide
atggccggcctgaccttatttgtgggccgcctcccgccctcggcccgcagtgagcagctggaggaactgttcagtcaggtggggccggtgaagcagtgcttcgtggtgactgaaaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacatcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccataaggtctgactgcctgtagggtcaggcaaaaagagccatatttttcttcttgcagagagcctataaatgggtgtgcaagtaggagagatatcgctaaattcttttcctagcaagaaatattaatattaagaccttaggaaaataattgcatcccttgggggaggtctataaatggccactctgggagtgtctgtcttaagtggttgagataaagcctgaaataaggctctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtaaaattcctctctttgtactctttatttctcagaccagccaacacttagggaaaatagaaagaacctacgttgaaatattgggggcgggttcccccaata

SEQ ID NO: 3222 - DNA, 615 bp, Artificial Sequence; identical to SEQ ID NO: 1055
  Synthetic polypeptide

SEQ ID NO: 3223 - DNA, 861 bp, Artificial Sequence; identical to SEQ ID NO: 1056
  Synthetic polypeptide

SEQ ID NO: 3224 - DNA, 62 bp, Artificial Sequence; identical to SEQ ID NO: 1057
  Synthetic polypeptide

SEQ ID NO: 3225 - DNA, 123 bp, Artificial Sequence; identical to SEQ ID NO: 1058
  Synthetic polypeptide

SEQ ID NO: 3226 - DNA, 501 bp, Artificial Sequence; identical to SEQ ID NO: 2341
  Synthetic polypeptide

SEQ ID NO: 3227 - DNA, 280 bp, Artificial Sequence
  Synthetic polypeptide
atgcagaagcccagcggcctgaagccccccggccgtggggggaagcactccagccccatgggccggacatctactgggtcagcttcatcctcggcggcggtggccgctagctccaaggaaggcacggtggtgtatacctgtggttccagttacttggcagcctgaagtaggagatccgcttgagcccaggaggtcgaggctgcggtgagttttgatcacaccactgcactccaacctgggtgacccagcgagaccctgactcaaaaacaaaacaaaaaaa

SEQ ID NO: 3228 - DNA, 500 bp, Artificial Sequence; identical to SEQ ID NO: 204
  Synthetic polypeptide

SEQ ID NO: 3229 - DNA, 656 bp, Artificial Sequence; identical to SEQ ID NO: 205
  Synthetic polypeptide

SEQ ID NO: 3230 - DNA, 524 bp, Artificial Sequence; identical to SEQ ID NO: 207
  Synthetic polypeptide

SEQ ID NO: 3231 - DNA, 559 bp, Artificial Sequence
  Synthetic polypeptide
atggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3232 - DNA, 508 bp, Artificial Sequence
  Synthetic polypeptide
atgtggggcgacctcacagagacgggatgtatgggacggcggagtgcaaagaaagatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3233 - DNA, 453 bp, Artificial Sequence
  Synthetic polypeptide
atcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3234 - DNA, 415 bp, Artificial Sequence
  Synthetic polypeptide
atgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3235 - DNA, 329 bp, Artificial Sequence
  Synthetic polypeptide
gatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctc

SEQ ID NO: 3236 - DNA, 359 bp, Artificial Sequence; identical to SEQ ID NO: 2309
  Synthetic polypeptide

SEQ ID NO: 3237 - DNA, 321 bp, Artificial Sequence; identical to SEQ ID NO: 2310
  Synthetic polypeptide

SEQ ID NO: 3238 - DNA, 679 bp, Artificial Sequence
  Synthetic polypeptide
atgttcgccccccggctgctggatttccagaagacgaaatacgcgaggttcatgaaccaccgagtccctgcccacaagaggtaccagcccacagagtatgaacatgcggccaactgtgccacccatgctttctggatcatccccagcatcctgggcagctccaacctctacttcctgtcggacgatgactgggagaccatctctgcctggatctacggcctcggcctctgcggcctcttcgtggtgtccactgtgtttcacaccatctcctggaagaagagccacctcaggatggtggaacactgtctacacatgttcgaccggatggtcatctatttcttcatagcggcttcctacgcaccctgagtccaagtgaattttatggtgaagaaacatttgtttgaagttcagcaaaatttgtaagtgtccattttcttcttttgaagtcaagttaaaattaaatgtaatacttttaattaaaaaagatgtgtataactttaattctcaccctttctcctttcccttcatcccgtcctatccttctacccagtgacctatttttaggtctacttggaaggatatctagaatgatgttcactgatggttattttgggtaatgagatgggttattattttttactcttaaacttttcggtgttacttaaattctttataatga

SEQ ID NO: 3239 - DNA, 1808 bp, Artificial Sequence
  Synthetic polypeptide
atggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3240 - DNA, 788 bp, Artificial Sequence
  Synthetic polypeptide
atggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3241 - DNA, 1589 bp, Artificial Sequence
  Synthetic polypeptide
atggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3242 - DNA, 986 bp, Artificial Sequence
  Synthetic polypeptide
atggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggccaggcacagtggctcacaactgtaatcccggcactttgggaggttgagacaggagaattgcttgaggccagaagttcaagaccagcctcggcaacatagtaagacccccatctctacaaaaaggttaaaaactagccaggtgtggtggcacacacctatagtcccagttactctgaaagctgaagcaagaggatgagttgaaccctaggaggtagaggctgcagtgagctgtgatcatgccactgcactccagcctgggcaacagagcaagaccctatctaaaaaaaaaaaaaaaaaaaaaaaaaaaaa

SEQ ID NO: 3243 - DNA, 651 bp, Artificial Sequence; identical to SEQ ID NO: 2328
  Synthetic polypeptide

SEQ ID NO: 3244 - DNA, 1382 bp, Artificial Sequence
  Synthetic polypeptide
atgaagactctcagggcgcgatttaagaagacagagctgcggctcagccccactgaccttggctcctgcccgccctgcggcccctgccccatcccgaagccggcagccagaggcaggcgccagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagccacctgggcctcctcgctgttcctccaactcgccaggcgcagtcctgcctcagggcctttgcaccaccagtgtcctctgcctggaatgctctagcgcagtcctgcctcagggcctttgcaccacctgtgtcctctgcctggaatgctctagccccagatggccccacagctctttacctcacctactttatgcagtaggctcctcgccaaagacacttcccatgcccacttcccatgcccacttcccatgcccactttcttcaaaattgtaacatcaccccccaccacccccccggccaactcgctagttcactttattttt

SEQ ID NO: 3245 - DNA, 1295 bp, Artificial Sequence
  Synthetic polypeptide
atgaagactctcagggcgcgatttaagaagacagagagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagccacctgggcctcctcgctgttcctccaactcgccaggcgcagtcctgcctcagggcctttgcaccaccagtgtcctctgcctggaatgctctagcgcagtcctgcctcagggcctttgcaccacctgtgtcctctgcctggaatgctctagccccagatggccccacagctctttacctcacctactttatgcagtaggctcctcgccaaagacacttcccatgcccacttcccatgcccacttcccatgcccactttcttcaaaattgtaacatcaccccccaccacccccccggccaactcgctagttcactttattttt

SEQ ID NO: 3246 - DNA, 1652 bp, Artificial Sequence
  Synthetic polypeptide
atgcagccggcggcctgcgctggtgagggagccgggcccccggcgccgcgtcctcctcatcctccaggcgacaaggtcaggaggggccggggcggcgccccttccctcagcccccagcccccagccccctacctgggtcttcccattccatcccgtgggggagggggctggcgaggagggcaagggggagggggcggcaccagggagggcgggaccgggcgggcgggcggggcggggagctccggcagcgcccagccccgccctccggccgctccccgcggtccctccagaccctctggccgccgcctcctcttggaaccccgtgcgccccccgcgccccgcgccccggacgccatgaagcagctgtgtctgtgcgcagccgcctccttcgcgagtcaagactggggcaagagtgacgagaggctgctacaagccgtggaaaacaacgatgcacctcgggtggccgccctcatcgcccgcaaggggctggtgcccacgaagctagaccccgagggcaagtccgcgttccacctggcggccatgcggggtgcggccagctgtctggaggtgatgatagctcatggcagcaatgtcatgagcgcggacggggcaggttacaatgccctccacctggccgccaaatacgggcacccacagtgcttgaagcaactactgcaggcttcctgcgtggtggacgtcgtggacagcagcgggtggactgccctacaccatgcagcggctggtggctgtctctcctgctcagaggtgctctgctcctttaaggcacatctaaacccccaagatcggtcaggcgcaacacccctcattatagcagctcagatgtgtcacacagacctgtgccgtctcctactgcagcaaggggctgccgcgaacgatcaggacctgcaaggcaggacggccctgatgctggcctgtgagggggccagccccgaaacagtggaggtcctgctgcagggcggagcccagccgggcatcaccgatgcgctggggcaggacgcggctcactatggcgccctggcgggggacaaactcatcctgcaccttctgcaagaggcggcccagcgcccctccccacccagcgccctcacagaggatgattcaggcgaggcgtcatctcagaactctatgtccagccatggaaagcagggggcccccaagaagcggaaggcgcctccacctcccgccagcattcccatgccggatgatcgagatgcctatgaggagatcgtgaggctgcggcaggagaggggccgcctcctgcagaagatccggggcctggaacagcacaaggaacggaggcagcaggagccacctgggcctcctcgctgttcctccaactcgccaggcgcagtcctgcctcagggcctttgcaccaccagtgtcctctgcctggaatgctctagcgcagtcctgcctcagggcctttgcaccacctgtgtcctctgcctggaatgctctagccccagatggccccacagctctttacctcacctactttatgcagtaggctcctcgccaaagacacttcccatgcccacttcccatgcccacttcccatgcccactttcttcaaaattgtaacatcaccccccaccacccccccggccaactcgctagttcactttattttt

SEQ ID NO: 3247 - DNA, 285 bp, Artificial Sequence; identical to SEQ ID NO: 1623
  Synthetic polypeptide

SEQ ID NO: 3248 - DNA, 1094 bp, Artificial Sequence; identical to SEQ ID NO: 153
  Synthetic polypeptide

SEQ ID NO: 3249 - DNA, 1668 bp, Artificial Sequence
  Synthetic polypeptide
atgctcctatgttaccgccacctaaaaacaaagaggattttgagaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3250 - DNA, 2895 bp, Artificial Sequence
  Synthetic polypeptide
atggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctggtgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3251 - DNA, 2892 bp, Artificial Sequence
  Synthetic polypeptide
atggcggacaaaacgccaggcggatctcagaaggccagttcaaagacgagatcatcagatgttcattcatctggatcttcagatgcacatatggatgcatctggaccctcagatagtgatatgccaagtcggacacgacctaagagcccaagaaaacataattataggaatgaaagtgcccgtgaaagcctttgtgattctcctcatcagaatctctcaagacctcttctggaaaacaaacttaaagcattcagtattggaaaaatgagtacagctaagcgaactttaagtaaaaaggaacaggaagaattaaagaaaaaggaggatgaaaaggcagctgctgagatttatgaggagtttcttgctgcttttgaaggaagtgatggtaataaagtgaaaacatttgtgcgagggggtgttgttaatgcagctaaagaagaacatgaaacagatgaaaaaagaggtaaaatctataagccatcttcaagatttgcagatcaaaaaaatcctccaaatcagtcttccaatgaaagaccaccatctcttcttgtgatagaaaccaaaaaacctccacttaaaaaaggagagaaagaaaagaaaaaaagcaatttggaactcttcaaagaagaattaaagcaaattcaagaggaacgtgatgagagacataaaacaaaaggcagattaagtcgatttgaacctcctcagtcagattctgatggtcagcgtcgttctatggacgcgccttcaagaagaaatagatcatctgttcttgatgattacgcacctggctcacatgatgtaggagatccaagcactactaatttataccttggaaacattaatccacagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaagactctgtcgcaagccatagtcaaagtggttatcccaacagaaaggaatttgctcgccctgatacatcgaatgatagagtttgttgtacgtgaagggccaatgtttgaagctatgattatgaacagagaaatcaacaatcctatgttcaggttcttatttgaaaaccagacaccagcccatgtttactataggtggaagctttattctattctgcaggcaaattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3252 - DNA, 1596 bp, Artificial Sequence
  Synthetic polypeptide
atgatagagtttgttgtacgtgaagggccaatgtttgaagctatgattatgaacagagaaatcaacaatcctatgttcaggttcttatttgaaaaccagacaccagcccatgtttactataggtggaagctttattctattctgcagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagaacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaagattgccagattatatttggtttctgatgttttgtacaactcttcagccaaagttgctaatgcttcatattatagaaaattttttgaaacaaagttatgtcagatattttcagacctcaatgccacctatcgtacaattcaaggccatttacaatctgaaaactttaagcaacgggtaatgacttgcttcagagcatgggaagattgggcaatttatccagaaccatttttgatcaaactacaaaatattttcttaggacttgtaaatattattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3253 - DNA, 853 bp, Artificial Sequence
  Synthetic polypeptide
tattgaagaaaaggaaacagaggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgcctttggatgcaactgaagactcaaaaaagaatgagcctatatttaaagttgccccatcaaaatgggaagctgtggatgaatctgaattggaagcacaggctgttacaacttctaaatgggaattatttgaccagcatgaagaatcagaagaagaagaaaatcaaaatcaagaagaagaaagtgaagatgaagaagatactcaaagttccaaatctgaagaacatcatttgtactctaatccaatcaaagaagaaatgactgagtctaagttctctaagtactctgaaatgagtgaggaaaaacgagccaaacttcgtgaaattgagctcaaagttatgaagtttcaggatgaattggaatctgggaaaagacctaaaaaaccaggccagagttttcaggagcaagtagaacactacagagataaacttcttcaacgagtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgtt

SEQ ID NO: 3254 - DNA, 200 bp, Artificial Sequence
  Synthetic polypeptide
atgagtgccaacaccttcggcaatgccggcttttccgttctcctgcctggggcccggctcgagggccgctgtgggcccaccaatgcccgggtcagatgccatctggataaccagatgcaacgtgaagatctagactggaccctggtttgatgaaccagctgtaaaaacacatttctggaacaactggagaaaccggagta

SEQ ID NO: 3255 - DNA, 1043 bp, Artificial Sequence
  Synthetic polypeptide
atgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctggataaccagatgcaacgtgaagatctagactggaccctggtttgatgaaccagctgtaaaaacacatttctggaacaactggagaaaccggagta

SEQ ID NO: 3256 - DNA, 821 bp, Artificial Sequence
  Synthetic polypeptide
atgcgaatcctaaagcgtttcctcgcttgcattcagctcctctgtgtttgccgcctggaagctgctggagtatatgctccagtgctcaccaaaataagggaataaaccaataaaggggattcatgggattcaggaaaccagagttgcagccagtgaaacagcaatcaaaatgacctgagcacacaagctaggcagagcctgctgccctcagtccaactggaacgagttccagtccaactggaatgagaggatttcggggaggaaagtggaaattctatattacttattcattgactgcatcagacaatatattaatccatatgtgttttgaaaatctagaagtgttttacagatttggagaaaattagcaattggtcctgagaaaataatcaaatttaaaagaccttaattaactgcaagaaaaagtcgagtagaaagtataatcataatacactactttgctcaacagtcatgaatatttacataatgataacgttgaatacctctaaaatatgatatttatactctaggtttggagagaatagaactatttaagttagcataaatacttatacatgaaagtaaaaaggtaatatatagtatctaaaatttagaagtcaaaaattacaataagagtatgttatctgaaaatatggagttaaattacagaagagatagctgaaagaattgaaaatgtgacctgtgggacactggactggagaggtggagtgaaatgaagcagggtacagctgctttccattatgagtctggcagtagtccttgaagttttaaactacatgcatgtctaacaaaaaagtaaa

SEQ ID NO: 3257 - DNA, 162 bp, Artificial Sequence; identical to SEQ ID NO: 2231
  Synthetic polypeptide

SEQ ID NO: 3258 - DNA, 245 bp, Artificial Sequence
  Synthetic polypeptide
atgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggctgaagtaggaggatcacttgaggccgagtccaaggttacagtgaactatgattgcaccatacactccagcctgggtgacagagtgagagcctgtct

SEQ ID NO: 3259 - DNA, 125 bp, Artificial Sequence
  Synthetic polypeptide
ccagccgcaggggccacccgaacagtctctcctcctcacagaagcctggagctgggcatccaagaagaagcagcctcatttgttttctggtgtcatcgtaggtggccacctatggcttttgggaa

SEQ ID NO: 3260 - DNA, 115 bp, Artificial Sequence
  Synthetic polypeptide
gggccacccgaacagtctctcctcctcacagaagcctggagctgggcatccaagaagaagcagcctcatttgttttctggtgtcatcgtaggtggccacctatggcttttgggaa

SEQ ID NO: 3261 - DNA, 112 bp, Artificial Sequence
  Synthetic polypeptide
ccacccgaacagtctctcctcctcacagaagcctggagctgggcatccaagaagaagcagcctcatttgttttctggtgtcatcgtaggtggccacctatggcttttgggaa

SEQ ID NO: 3262 - DNA, 2114 bp, Artificial Sequence
  Synthetic polypeptide
atggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggggtgtcctgaaaccaaggcttcacggatatggagagacaaccg

SEQ ID NO: 3263 - DNA, 2357 bp, Artificial Sequence
  Synthetic polypeptide
atggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggacacagattcagaagaacagaccctcccttttccagtgccttcggaaagattgccgctccgtagaatgagtcctttctcctccacccttaatctacaacccagcttccccgggagatcctactttgatttccgatcctcaccccaccagctgagcttgcattcctctttacagtctctcaatgcaccgggatgcaattttgagacacaatctgcaccttactctcaattagttgacattaaaaagctgttggcagtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttaaatagaaaaaacttgacattttttatcaacgatgaacaacaaggtcccatagcatttgataacgtggagggcctcttcttccctgcggtcagcctgaacaggaacgtgcaggggtgtcctgaaaccaaggcttcacggatatggagagacaaccg

SEQ ID NO: 3264 - DNA, 821 bp, Artificial Sequence; identical to SEQ ID NO: 2348
  Synthetic polypeptide

SEQ ID NO: 3265 - DNA, 656 bp, Artificial Sequence; identical to SEQ ID NO: 2349
  Synthetic polypeptide

SEQ ID NO: 3266 - DNA, 780 bp, Artificial Sequence; identical to SEQ ID NO: 2350
  Synthetic polypeptide

SEQ ID NO: 3267 - DNA, 439 bp, Artificial Sequence; identical to SEQ ID NO: 2351
  Synthetic polypeptide

SEQ ID NO: 3268 - DNA, 2961 bp, Artificial Sequence
  Synthetic polypeptide
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagtaagtggggataaaatgccctgattcaccctcagagggatg

SEQ ID NO: 3269 - DNA, 2964 bp, Artificial Sequence
  Synthetic polypeptide
atgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagtaagtggggataaaatgccctgattcaccctcagagggatg

SEQ ID NO: 3270 - DNA, 2827 bp, Artificial Sequence
  Synthetic polypeptide
atggctgtgtactgctatgcgctcaatagcctggtgatcatgaatagcgccaacgagatgaagagcggcggcggcccggggcccagtggcagcgagacgcccccgcccccgaggagggcagtgctgagccccggcagcgttttcagccccgggagaggcgcctctttcctcttccccccagccgagtcgctgtcccccgaggagccccggagccccgggggctggcggagcggccggcgcaggctgaatagtagcagcggcagtggcagcggcagcagcggcagtagcgtgagcagcccaagttgggctggtcgcctgcgaggggaccggcagcaggtggtggcagccggtaccctctccccgccagggccggaggaggccaagaggaagctgcggatcttgcagcgcgagttgcagaacgtgcaggtgaaccagaaagtgggcatgtttgaggcgcacatccaggcacagagctccgccattcaagcgccccgcagcccgcgtttgggcagggctcgctcgccctccccgtgccccttccgcagcagcagtcagccccctggaagggtcctggttcagggcgcccggagcgaggaacggaggacaaagtcctggggggagcaatgtccagagacttcaggaaccgactccgggaggaaaggagggcccagcctatgctcctcgcaggtgaagaaaggaatgccacctcttcccggccgggctgcccctacaggatcagaggctcagggtccatccgcttttgtaaggatggagaagggtatccctgccagtccccgctgtggctcacccacagctatggaaattgacaaaaggggctctcctaccccgggaactcggagctgcctagctccctcattggggctgttcggagctagcttaacgatggccacggaagtggcagcgagagttacatccactgggccacaccgtccacaggatcttgccctcactgagccgtctgggagagcccgtgagcttgaggacctgcagcccccagaggccctggtggagaggcaggggcagtttctgggcagtgagacaagcccagccccagaaaggggcgggccccgcgatggagaaccccctgggaagatggggaaaggatatctgccctgtggcatgccgggctctggggagcctgaagtgggcaaaaggccagaggagacgactgtgagcgtgcaaagcgcagagtcctctgattccctgagctggtccaggctgcccagggccctggcctccgtaggccctgaggaggcccgaagtggggcccccgtgggcggggggcgttggcagctctccgacagagtggagggagggtccccaacgctgggcttgcttgggggcagcccctcagcacagccggggaccgggaatgtggaggcgggaattccttctggcagaatgctggagcctttgccctgttgggacgctgcgaaagatctgaaagaacctcagtgccctcctggggacagggtgggtgtgcagcctgggaactccagggtttggcagggcaccatggagaaagccggtttggcttggacgcgtggcacaggggtgcaatcagaggggacttgggaaagccagcggcaggacagtgatgccctcccaagtccggagctgctaccccaagatccggacaagcctttcctgaggaaggcctgcagccccagcaacatacctgctgtcatcattacagacatgggcacccaggaggatggggccttggaggagacgcagggaagccctcggggcaacctgcccctgaggaaactgtcctcttcctcggcctcctccacgggcttctcctcatcctacgaagactcagaggaggacatctccagtgaccctgagcgcaccctggaccccaactcagccttcctgcataccctggaccagcagaaacctagagtgagcaaatcatggaggaagataaaaaacatggtgcactggtctcccttcgtcatgtccttcaagaagaagtacccctggatccagctggcaggacacgcagggagtttcaaggcagctgccaatggcaggatcctgaagaagcactgtgagtcagagcagcgctgcctggaccggctgatggtggatgtgctgaggcccttcgtacctgcctaccatggggatgtggtgaaggacggggagcgctacaaccagatggacgacctgctggccgacttcgactcgccctgtgtgatggactgcaagatgggaatcaggacctacctggaggaggagctcacgaaggcccggaagaagcccagcctgcggaaggacatgtaccagaagatgatcgaggtggaccccgaggcccccaccgaggaggaaaaagcacagcgggctgtgaccaagccacggtacatgcagtggcgggagaccatcagctccacggccaccctggggttcaggatcgagggaatcaagaaagaagacggcaccgtgaaccgggacttcaagaagaccaaaacgagggagcaggtcaccgaggccttcagagagttcactaaaggaaaccataacatcctgatcgcctatcgggaccggctgaaggccattcgaaccactctagaagtttctcccttcttcaagtgccacgaggccatcaaactctgaacagtcatgcaaccggagcttctgatgatggcctcttctgctggggacccttagacaggcatctgagggacctctgactgccatttcccaaaaacagtgccccctgtcagcaggaagcagttaagatcagtcttcatccttatccttaatctaagggcagttagatggacttctttcgaggcgggaa

SEQ ID NO: 3271 - DNA, 976 bp, Artificial Sequence; identical to SEQ ID NO: 2334
  Synthetic polypeptide

SEQ ID NO: 3272 - DNA, 1009 bp, Artificial Sequence; identical to SEQ ID NO: 2335
  Synthetic polypeptide

SEQ ID NO: 3273 - DNA, 1132 bp, Artificial Sequence; identical to SEQ ID NO: 2336
  Synthetic polypeptide

SEQ ID NO: 3274 - DNA, 563 bp, Artificial Sequence; identical to SEQ ID NO: 2337
  Synthetic polypeptide

SEQ ID NO: 3275 - DNA, 1358 bp, Artificial Sequence; identical to SEQ ID NO: 2339
  Synthetic polypeptide

SEQ ID NO: 3276 - DNA, 1913 bp, Artificial Sequence
  Synthetic polypeptide
tgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 3277 - DNA, 2460 bp, Artificial Sequence
  Synthetic polypeptide
atgggagcagtaagctgtcggcaggggcagcacacccagcagggggaacacacccgggtggctgtccctcacaagcagggtggcaacatccggggtccctgggcccgaggctggaagagcctctggacaggtttgggaaccatcaggtcagatctggaagaactctgggaactacgggggcaccactatctgcaccaggaatccctaaagccagccccagtactggtagagaagcctctgccagagtggccagtgcctcagttcatcaacctctttctaccagagtttcccattaggcccattagggggcagcagcagctgaagattttaggcctcgtggctaaaggctcctttggaactgtcctcaaggtgctagattgcacccagaaagctgtatttgcagtgaaggtggtgcccaaggtaaaggtcctacagagggataccgtgaggcagtgcaaagaggaggttagcatccagcgacagatcaaccatccctttgtacacagcttgggggacagctggcagggaaaacggcaccttttcattatgtgtagctactgcagcacagatctgtactccctttggtcggctgttggctgctttcctgaggcttccatccgtctctttgctgccgagttggtgctggtactgtgttatctccatgacttgggcatcatgcatcgagatgtgaagatggagaatattcttctagatgaacgagctggactgtgctgctgccatctcggctcactgcaacctccctgcctgattctcctgactcagcctgtcgagtgcctgcgattgcaggcgcgcggcgccatgcctgactggttttcgtatttttttggtggagacggggtttcgctgtgttggccggactggtctccagctcctaactgcgagtgatccgccagcctcggcctcccgaggtgccgggattgcagacggagtctcgttaactcagtgctcagtggtgcccaggctggagtgcagtggcgtgatctcggctcgctacaacctccacctcccagccgcctgccttggccccccaaagtgccgagattgcagcctctgcccggacgccaccccgtctgggaagtgaggagcgtctctgcctggccgcccatcgtctgggatgtgaggagcccctctgcctggctgcccagtctggaaggtgaggagcgtctctgcccggccgccatcccacctaggaagtgaggagcacctcttcccggccaccatcccatctaggaagtgaggagcgtctctgcccggctgcccatcgtctgagatgtggggagcgcctctgccccgccgccccgtctgggatgtgaggagcgccttggcccggccgtgaccccgtctgggaggtgaggagcgtctctgcccggccaccccgtctgagaagtgaggagaccctccgcccggcaactgccccgtctgagaagtgaggagcccctccgcccggcagccgccccgtctgagaagtgaggagcccctccgcccggctgccaccccgtctgggaagtgaggagcgtctccgcccagcagccaccccgtccgggagggaggtgggggtcagcccccgccaggccagctgccccatccgggagggaggtggggtgtcagccccctgcccggccagccgccccgtccgggaggtgaggggcgcctctgcccggctgcccctactgggaagtgaggagcccctctgcccggccagccgccccgtccgggagggaggtgggggagtcagccccccgcccggccagccgccccttccaggagggaggtggggggttcagcccaccgcccggccagccgccccgtccgggagggaggtgggggggtcagccccccgcccggccagccgccccgtctgggaggtgaggggcgcctctgcccggctgcccctgctgggaagtgaggagcccctctgctgggccaccaccccgtctgggaggtgtacccagcagctcattgagaacgggccatgatgacaatggcggttttgtggaatagaaaggggggaaaggtggggaaaagattgagaaatcggatggttgctgtgtctgtgtagagggaggtagacatgggagacttttcattttgttctgtactaagaaaaattcttctgccttgggatcctgttgatctatgaccttacccccaaccctgtgctctctaaaacatgtgctgtgtccactcagggttaaatggattaagggcggtgcaagatgtgctttgttaaacagatgcttgaaggcagcatgcttgttaagagtcatcaccactccctaatcgcaagtacccagggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaa

SEQ ID NO: 3278 - DNA, 3961 bp, Artificial Sequence; identical to SEQ ID NO: 1670
  Synthetic polypeptide

SEQ ID NO: 3279 - DNA, 483 bp, Artificial Sequence; identical to SEQ ID NO: 2246
  Synthetic polypeptide

SEQ ID NO: 3280 - DNA, 4277 bp, Artificial Sequence; identical to SEQ ID NO: 2069
  Synthetic polypeptide

SEQ ID NO: 3281 - DNA, 934 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3282 - DNA, 937 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcatggtgttccaaacacagggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3283 - DNA, 767 bp, Artificial Sequence
  Synthetic polypeptide
atgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcatttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaa

SEQ ID NO: 3284 - DNA, 461 bp, Artificial Sequence
  Synthetic polypeptide
atggccttaaagagcacaagtatcggcctttgtcttagtcaagctttcgaggagcaactcagcaattctgttaccgataatcacctaacagtttacacattcaaaaccactgggaagccacagaccaggcaccgtgggatggggaagtggagaccgagaggctgctgccggggaaatatgcagtgcagacaagagggtaatgggtgtcccgatctcgcgggggactctgtgatccgtgttcccctgaccctcctagtgcacaacttggccgggctcactgggctcctgcaccactgcctgtcaggcacatcctcaccctcggagcctccttctcctcacctgcaagacagaggtgacagggctcacctctcaaggctgctgagcgggctggacgctactgcttagatgcaacctccttgcaaactgtagagtgctctgagaaggtcagttgttgtcactgt

SEQ ID NO: 3285 - DNA, 1673 bp, Artificial Sequence
  Synthetic polypeptide
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaa

SEQ ID NO: 3286 - DNA, 1481 bp, Artificial Sequence
  Synthetic polypeptide
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcatactaacaaaactactgatgccagccattctgaaagtcttggcaagaaactcacttagggaggactgtagtttccatatcctgatgatttcagtccctgacctgaatcaattgatgacctcaatttccagcccctcacccttcaaagactcttgcccagaaacccttaatgaaatgggtttgagttttgagaattcttcccaagtccttgcttggtgaccttgcaattagtaagttctttctctgttgcaaaccccacagtctcggtgtattgttctgtagctgtgcagccggcatagaaacctgacagtcttgtaa

SEQ ID NO: 3287 - DNA, 1596 bp, Artificial Sequence
  Synthetic polypeptide
atgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggcacagactgccaaggctgggggcaacatatctgtatcaaaagaggaagcttggaaaccggtaggaccttgacgccaggtggcctcaaatctccacttcctgcattctgctgcaatgctcctcacctgccccaggtatggttcacgcaggcccatgtgcagtttgggccactctctggaaggcaatatagtaaatcttggtggtgtctgtgcagtgctatctctaccaaagtgcagagtgcacaagtcatgagggcatgcctgcctccacttagatttcaaaggatgccccagaaagcctcagagcccagacagagaactatcacaggagcaggaccaccacagacagcccccaccccagtatggcaatgcccagtgaaaccgtgggagcagagccacccccaagaccccagactggtagagccaccagtgtgcaattccagcctgggagagccataggcatgtgactccaatatgtgagaaatgctatatgggttttgcccagcaaagtcatggccaggactaccccccaccccccaagtgtttagaaggtaaaatgtcaagtcgaagattattcttgagccttaatatttgccctgttgggttttacagttagtcaggatttattatctttttcttccttcctacttctaccttttggaaaggaaatgtctgccctgtgcctatcccaccattgtattttcaaagcatgtaacttgtttgatttcagaggctcacagctgaaggggaatttgcctcaggatgagtcacacctttgagtctcagtcatatttgatttaaatgagactttggacctcagacttttgaattggtgctggaacaagttaaggcctggggagctactgggatggaatgaatacattctgcatgtgagaagaacatacatttcggacggccagaagcagaa

SEQ ID NO: 3288 - DNA, 881 bp, Artificial Sequence; identical to SEQ ID NO: 2412
  Synthetic polypeptide

SEQ ID NO: 3289 - DNA, 803 bp, Artificial Sequence; identical to SEQ ID NO: 2413
  Synthetic polypeptide

SEQ ID NO: 3290 - DNA, 5929 bp, Artificial Sequence
  Synthetic polypeptide
atgaagctaccggccagggttttctttactctggggtcccggctgccctgtggcctcgctcctcggaggtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagaatgcagctcctcgccagcaacggaacaaagctggacggagaatgactttgacgagttgagagaagaaggcttcagatgattggtaataacagacttctctgagctaaaggaaggtgttggaacccatcgccagaaagctaaaaaccttgataaaagattagatgatggctaactagaataaacagcatagagaagaccctaaatgacctgatggagctgaaaaccatgacatgagaaatacgtgatgcatgaacaagcttcagtagctgattcgatcaagtggaggaaagggtatcagtgattgaagatcaaatgaatgaaatgaagtgagaagagaagtttagagaaaaaagagtaaaaagaaatgaacaaagcctccaagaaatatgggactatgtgaaaagaccaaatctacgtctgattgtacctgaaagtgacagggagaatggaaccaagttggaaaacatgctgcaggatattatccaggagaatttccccaacctaccaacgcaggccaacattcaaattcaggaaatacagagaaggctacaaagatactccctgagaagagcaactccaagacacataattgtcagattgactaaagttgaaatgaggaaaaaatgctaagggcagacagagagaaaggtcaggttacccacaaagggaagcccatcagactaacagtggatctctcagcagaaactacaagtcagaagaaagtgggggccaatattcaacattcttaaagaaaataatttttaacctagaatttcatatccagccaaactaagcttcataagtgaaggagaaataaaatactttacagacaagcaaatgctgagattttgtcaccaccaggcctgccttacaagaactcctgaaggaagcactaaacatggaaaggaacaaccggtaccagccactgcaaaaacaggccaaattgtagagaccatcaatgctacaaaaaaactgcatcaactaacgagcaaaataaccagctgacatcataatgacaggatcaaattcacacataacaatattaaccttaaatgtaaatgggctaaatgctccaattaaaagacacagactggcaaattggataaagagtcaagacccatcagtgtgctgtatttaggagacccatctcacatgcagagacacacataggctcaaaataaaggcatggaggaaaccctaccaagcaaatggaaaacaaaaaaaaagcaggggttgcaatcctagtctctgataaaacagactttaaaccaacaaagatcagaagagagaaagaaggccattacatattggtaaagggatcaattcaacaagaagagctaactatcctaaatatatttgcacccaatacaggagcacccagattcataaagcaagtccttagagacctacaaagagacttagactcccacacaataataatgggagactttaacgccccactgtcaatattagacagaacaacaagacagaaagttaacaaggatatccaggaattgaactcagctctgcaccaagcagacctaatagacatctacagaactctccacctcaaatcaacagaatatatattctttttagcaccacatctcacttattccaaaattgaccacataggtggaagtaaagcactcctcagcaaatgtaaaagaacagaaattataacaaactgtctctcagaccacagtgcaatcaaacgacaactcaggtttaagaaactcactcaaaaccgctcaactacatggaaactgaacaacctgttcctgaatgactactgggtacataacgaaatgaaggcagaaataaagatgttctttgaagccaatgagaacaaagacacaacataccagaatctctgggacacatttaaagcagtgtgtagagggaaatttatagcactaaatgcccacaagagaaagcagggaagatctaaaatgggcaccctaacatcacaattaaaagaactagagaagcaagagcaaacacattcaaaagctagcagaaggcaagaaagtactaagatcagagcagaactgaaggagatagagacacaaaaaacccttcaaaaaatcaatgaatccaggagctgttttttttgaaaagaccaaaaaaattgatagaccgctagcaagactaataaagaagaaaagagtgaagaatcaaatagatgcaataaaaaatgataaaggggatatcaccacctatcccacagagatacaaactcccatcagagaatactataaacaccactatgcagataaactagaaaatctagaagaaatggatacattcctgtacacatacactctcccaagactaaacctggaagaagttgaatccctgaatacaccaataacacactctgaaattgaggcaataattaaaagcctactaaccaaaaaaagtccaggaccagacagattcacagccaaattccaccagaggtacaaagaggagctggtaccattccttctgaaactattccaatcaatagaaaaagaggtaatcctccctgactcattttatgaggccagcatcatcctgatacgaaagcctggcagagatacaacaacaaaaaaagagaattttagaccaatattcctgatgaacattgatgcaaaaaacttcagtaaaatactggcaaaccaaatccagcagcacatcaaaaaggttatccaccacgatcaagtgggcctcatccctgggatgcaaggctggttcaacatacccaaatcaataaacataatccatcatataaacagaaccaaagacaaaaaccacatgattatctcaatagatgcagaaaaggccttcgacaaaattcaactgcccttcatgctaaaaactctcagtaaactaggtattgatgggacatgcctcaaaataataagagctatttatgacaaacccacagccagggggcaaaatctggaagcattccctttgaaaactggcacaagacagggatgccctctctcaccactcctattcaacatagtgttggaagttctggtcagggcagtcaggcaggagaaataaataaagggtattcaattaggaaaagagaaagtcaaattgtacctgtttgcagatgacatgattgtatatttagaaaaccccatcatctcagcccaaaacctccttaagctgataagcaacttcagcaaagtctcaggatacaaaatcaatgtgcaaaaatcacaagcattttttacaccaataacagacaagcagagagccaaatcatgagtgaactcccattcacaattgcttcaaagagaataaaatacctaggaatccaacttacaagggatgtgaagtacctcttcaaggagaactacaaaccactgctcagtaaaattaaagaggacacaaacaaatggaagaacattccatgctcatggataggaagaatcaatgtgtgaaaatggccacactgcccaaggtaatttatagattcagtgccatccccatcaagctaccaatgactttcttcacagaattggaaaaaactacttttaaagttcatatggaaccaaaaaagagcccacattgccaagacaatcctaagccaaaagaacaaagctggcatcatcacactacctgacttcaaactatactacaaggctacagtaaccaaaacagcatggtacggtaccaaaacagagatatagaccaacggaacagaacagagccctcagaaataataccacacatctacaaccatctgatctttgagaagcctgacaaatacaagaaatggggaaaggattccctgtttaataaatggtgctgggaaaactggctagccatatgtagaaagctgaaactggatgccttccttactccttatacaaaaattaattcaagatggattaaagacttaaatgttagacctgaaactataaacaccctagaagaaaacctaggcaatgccattcaggacataggcatggacaaggacttcatgactaaaacaccaaaagcaatggccacaaaagccaaaatagacaaatgagatctaattaaactaaagagcctctgcacagcaaaagaaactaccatcagagtgaacaggcaacctacagaatgggagaaaatgtttacaatctacccatctgacaaagggctaatatccagaatctacaaagaacttaaatttacaagaaaaaatcaaacaaccccatcacaaagtgggcaaagtgtatgaacagacacctctcaaaagaagatatttatgcagccaacagacacatgaaaaaatgctcatcatcactggccatcagagaaatgcaaatcaaaaccacagtgagataccatctcacaccagttagaatggtgttcattaaagattcaggaaacaacaggtgctggagaggatgtggaaaaataggaacacttttacgctgttggtgggactgtaaactagttaaaccattgtggaagacagtgtggtgattcctcaagggtctagaactagaaataccatttgacccagccatcccattactgggtatataccgaaagaattataaatcatggtgctataaagacacatgcacacgtatgtttattgcactactattcacaatagcaaagacttggaaccaacccagatgtctatcaatgatagactggattaagaaaatgtggcacatatacatcatggaatactatgcagacataaaaaaggatgagttcatgtcctttgtagggacatggatgaagctggaaaccatgattctgagcaaactctcacaaagacagaaaaccaaacaccgcatgttctcactcataagtgggaattgaacaatgaaaacacttggacacagggtggtgaacatcacacatgggggcccgtcgtggggtgggaggagcggggagggatagtattagcagatatacctaatgtaaatgacgagttaatgcgtgcagcacaccaacatggcacatgtatacatatgtaacaaacctgcacattgtgcacattcaccctagaacttcaagtataattaaaaaaaaaa

SEQ ID NO: 3291 - DNA, 5902 bp, Artificial Sequence
  Synthetic polypeptide
atgtcaggactggggaagaagcatctcctgctcatgggggagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggaagatggatgttttgaaagctaccgcagaacaaatttcttctcaaactggaaataaggttcatgcaattcagtgtgatgtgagggatcctgatatggttcaaaacactgtgtcagaactgatcaaagttgcaggacatcctaatattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggagcagcatttctttctattactactatctatgctgagactggttcaggttttgtagtaccaagtgcttctgccaaagcaggtgtggaagccatgagcaagtctcttgcagctgaatggggtaaatatggaatgcgattcaatgtgattcaaccagggcctataaaaaccaaaggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagaatgcagctcctcgccagcaacggaacaaagctggacggagaatgactttgacgagttgagagaagaaggcttcagatgattggtaataacagacttctctgagctaaaggaaggtgttggaacccatcgccagaaagctaaaaaccttgataaaagattagatgatggctaactagaataaacagcatagagaagaccctaaatgacctgatggagctgaaaaccatgacatgagaaatacgtgatgcatgaacaagcttcagtagctgattcgatcaagtggaggaaagggtatcagtgattgaagatcaaatgaatgaaatgaagtgagaagagaagtttagagaaaaaagagtaaaaagaaatgaacaaagcctccaagaaatatgggactatgtgaaaagaccaaatctacgtctgattgtacctgaaagtgacagggagaatggaaccaagttggaaaacatgctgcaggatattatccaggagaatttccccaacctaccaacgcaggccaacattcaaattcaggaaatacagagaaggctacaaagatactccctgagaagagcaactccaagacacataattgtcagattgactaaagttgaaatgaggaaaaaatgctaagggcagacagagagaaaggtcaggttacccacaaagggaagcccatcagactaacagtggatctctcagcagaaactacaagtcagaagaaagtgggggccaatattcaacattcttaaagaaaataatttttaacctagaatttcatatccagccaaactaagcttcataagtgaaggagaaataaaatactttacagacaagcaaatgctgagattttgtcaccaccaggcctgccttacaagaactcctgaaggaagcactaaacatggaaaggaacaaccggtaccagccactgcaaaaacaggccaaattgtagagaccatcaatgctacaaaaaaactgcatcaactaacgagcaaaataaccagctgacatcataatgacaggatcaaattcacacataacaatattaaccttaaatgtaaatgggctaaatgctccaattaaaagacacagactggcaaattggataaagagtcaagacccatcagtgtgctgtatttaggagacccatctcacatgcagagacacacataggctcaaaataaaggcatggaggaaaccctaccaagcaaatggaaaacaaaaaaaaagcaggggttgcaatcctagtctctgataaaacagactttaaaccaacaaagatcagaagagagaaagaaggccattacatattggtaaagggatcaattcaacaagaagagctaactatcctaaatatatttgcacccaatacaggagcacccagattcataaagcaagtccttagagacctacaaagagacttagactcccacacaataataatgggagactttaacgccccactgtcaatattagacagaacaacaagacagaaagttaacaaggatatccaggaattgaactcagctctgcaccaagcagacctaatagacatctacagaactctccacctcaaatcaacagaatatatattctttttagcaccacatctcacttattccaaaattgaccacataggtggaagtaaagcactcctcagcaaatgtaaaagaacagaaattataacaaactgtctctcagaccacagtgcaatcaaacgacaactcaggtttaagaaactcactcaaaaccgctcaactacatggaaactgaacaacctgttcctgaatgactactgggtacataacgaaatgaaggcagaaataaagatgttctttgaagccaatgagaacaaagacacaacataccagaatctctgggacacatttaaagcagtgtgtagagggaaatttatagcactaaatgcccacaagagaaagcagggaagatctaaaatgggcaccctaacatcacaattaaaagaactagagaagcaagagcaaacacattcaaaagctagcagaaggcaagaaagtactaagatcagagcagaactgaaggagatagagacacaaaaaacccttcaaaaaatcaatgaatccaggagctgttttttttgaaaagaccaaaaaaattgatagaccgctagcaagactaataaagaagaaaagagtgaagaatcaaatagatgcaataaaaaatgataaaggggatatcaccacctatcccacagagatacaaactcccatcagagaatactataaacaccactatgcagataaactagaaaatctagaagaaatggatacattcctgtacacatacactctcccaagactaaacctggaagaagttgaatccctgaatacaccaataacacactctgaaattgaggcaataattaaaagcctactaaccaaaaaaagtccaggaccagacagattcacagccaaattccaccagaggtacaaagaggagctggtaccattccttctgaaactattccaatcaatagaaaaagaggtaatcctccctgactcattttatgaggccagcatcatcctgatacgaaagcctggcagagatacaacaacaaaaaaagagaattttagaccaatattcctgatgaacattgatgcaaaaaacttcagtaaaatactggcaaaccaaatccagcagcacatcaaaaaggttatccaccacgatcaagtgggcctcatccctgggatgcaaggctggttcaacatacccaaatcaataaacataatccatcatataaacagaaccaaagacaaaaaccacatgattatctcaatagatgcagaaaaggccttcgacaaaattcaactgcccttcatgctaaaaactctcagtaaactaggtattgatgggacatgcctcaaaataataagagctatttatgacaaacccacagccagggggcaaaatctggaagcattccctttgaaaactggcacaagacagggatgccctctctcaccactcctattcaacatagtgttggaagttctggtcagggcagtcaggcaggagaaataaataaagggtattcaattaggaaaagagaaagtcaaattgtacctgtttgcagatgacatgattgtatatttagaaaaccccatcatctcagcccaaaacctccttaagctgataagcaacttcagcaaagtctcaggatacaaaatcaatgtgcaaaaatcacaagcattttttacaccaataacagacaagcagagagccaaatcatgagtgaactcccattcacaattgcttcaaagagaataaaatacctaggaatccaacttacaagggatgtgaagtacctcttcaaggagaactacaaaccactgctcagtaaaattaaagaggacacaaacaaatggaagaacattccatgctcatggataggaagaatcaatgtgtgaaaatggccacactgcccaaggtaatttatagattcagtgccatccccatcaagctaccaatgactttcttcacagaattggaaaaaactacttttaaagttcatatggaaccaaaaaagagcccacattgccaagacaatcctaagccaaaagaacaaagctggcatcatcacactacctgacttcaaactatactacaaggctacagtaaccaaaacagcatggtacggtaccaaaacagagatatagaccaacggaacagaacagagccctcagaaataataccacacatctacaaccatctgatctttgagaagcctgacaaatacaagaaatggggaaaggattccctgtttaataaatggtgctgggaaaactggctagccatatgtagaaagctgaaactggatgccttccttactccttatacaaaaattaattcaagatggattaaagacttaaatgttagacctgaaactataaacaccctagaagaaaacctaggcaatgccattcaggacataggcatggacaaggacttcatgactaaaacaccaaaagcaatggccacaaaagccaaaatagacaaatgagatctaattaaactaaagagcctctgcacagcaaaagaaactaccatcagagtgaacaggcaacctacagaatgggagaaaatgtttacaatctacccatctgacaaagggctaatatccagaatctacaaagaacttaaatttacaagaaaaaatcaaacaaccccatcacaaagtgggcaaagtgtatgaacagacacctctcaaaagaagatatttatgcagccaacagacacatgaaaaaatgctcatcatcactggccatcagagaaatgcaaatcaaaaccacagtgagataccatctcacaccagttagaatggtgttcattaaagattcaggaaacaacaggtgctggagaggatgtggaaaaataggaacacttttacgctgttggtgggactgtaaactagttaaaccattgtggaagacagtgtggtgattcctcaagggtctagaactagaaataccatttgacccagccatcccattactgggtatataccgaaagaattataaatcatggtgctataaagacacatgcacacgtatgtttattgcactactattcacaatagcaaagacttggaaccaacccagatgtctatcaatgatagactggattaagaaaatgtggcacatatacatcatggaatactatgcagacataaaaaaggatgagttcatgtcctttgtagggacatggatgaagctggaaaccatgattctgagcaaactctcacaaagacagaaaaccaaacaccgcatgttctcactcataagtgggaattgaacaatgaaaacacttggacacagggtggtgaacatcacacatgggggcccgtcgtggggtgggaggagcggggagggatagtattagcagatatacctaatgtaaatgacgagttaatgcgtgcagcacaccaacatggcacatgtatacatatgtaacaaacctgcacattgtgcacattcaccctagaacttcaagtataattaaaaaaaaaa

SEQ ID NO: 3292 - DNA, 518 bp, Artificial Sequence; identical to SEQ ID NO: 1648
  Synthetic polypeptide

SEQ ID NO: 3293 - DNA, 510 bp, Artificial Sequence; identical to SEQ ID NO: 1633
  Synthetic polypeptide

SEQ ID NO: 3294 - DNA, 952 bp, Artificial Sequence
  Synthetic polypeptide
atgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3295 - DNA, 835 bp, Artificial Sequence
  Synthetic polypeptide
atgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3296 - DNA, 209 bp, Artificial Sequence; identical to SEQ ID NO: 2913
  Synthetic polypeptide

SEQ ID NO: 3297 - DNA, 1091 bp, Artificial Sequence; identical to SEQ ID NO: 2614
  Synthetic polypeptide

SEQ ID NO: 3298 - DNA, 1118 bp, Artificial Sequence; identical to SEQ ID NO: 2615
  Synthetic polypeptide

SEQ ID NO: 3299 - DNA, 1325 bp, Artificial Sequence; identical to SEQ ID NO: 2616
  Synthetic polypeptide

SEQ ID NO: 3300 - DNA, 1229 bp, Artificial Sequence; identical to SEQ ID NO: 2617
  Synthetic polypeptide

SEQ ID NO: 3301 - DNA, 2721 bp, Artificial Sequence; identical to SEQ ID NO: 962
  Synthetic polypeptide

SEQ ID NO: 3302 - DNA, 2549 bp, Artificial Sequence; identical to SEQ ID NO: 963
  Synthetic polypeptide

SEQ ID NO: 3303 - DNA, 1490 bp, Artificial Sequence; identical to SEQ ID NO: 1677
  Synthetic polypeptide

SEQ ID NO: 3304 - DNA, 1451 bp, Artificial Sequence; identical to SEQ ID NO: 1678
  Synthetic polypeptide

SEQ ID NO: 3305 - DNA, 926 bp, Artificial Sequence; identical to SEQ ID NO: 1679
  Synthetic polypeptide

SEQ ID NO: 3306 - DNA, 1451 bp, Artificial Sequence; identical to SEQ ID NO: 1680
  Synthetic polypeptide

SEQ ID NO: 3307 - DNA, 690 bp, Artificial Sequence; identical to SEQ ID NO: 2745
  Synthetic polypeptide

SEQ ID NO: 3308 - DNA, 690 bp, Artificial Sequence; identical to SEQ ID NO: 2746
  Synthetic polypeptide

SEQ ID NO: 3309 - DNA, 825 bp, Artificial Sequence; identical to SEQ ID NO: 2747
  Synthetic polypeptide

SEQ ID NO: 3310 - DNA, 960 bp, Artificial Sequence
  Synthetic polypeptide
atgacgacttacagtgacaaaggggcaaagcctgagagaggccgattcctccacttccactctgtgaccttctgggttggcaacgccaagcaggccacgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgctactcaggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3311 - DNA, 843 bp, Artificial Sequence
  Synthetic polypeptide
atgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgctactcaggaggctgaagcaggagaatcgcttgaaccgggaggcagaggttgcagtgagctaagatcgtgccactgcactccagcctgggcaacagagactccatctcaaaaaaaaagaaaaaaagaaa

SEQ ID NO: 3312 - DNA, 2570 bp, Artificial Sequence
  Synthetic polypeptide
atggcaggtccttccaaccctcctgctaccatgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaa

SEQ ID NO: 3313 - DNA, 2540 bp, Artificial Sequence
  Synthetic polypeptide
atgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccatcaactggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgcaggccgtgaggctgatcgctgagggcaaagcccccagactccctcagcctgaggaaggagccacctatgaggggattcagaagaaggagacagccaagatcaactgggaccagccggcagaggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaa

SEQ ID NO: 3314 - DNA, 2237 bp, Artificial Sequence
  Synthetic polypeptide
atgaagattgcagtgattggacagagcctgtttggccaggaagtttactgccacctgaggaaggagggccacgaagtggtgggtgtgttcactgttccagacaaggatggaaaggccgaccccctgggtctggaagctgagaaggatggagtgccggtattcaagtactcccggtggcgtgcaaaaggacaggctttgcctgatgtggtggcaaaataccaggctttgggggccgagctcaacgtcctgcccttctgcagccaattcatccccatggagataatcagtgccccccggcatggctccatcatctatcacccgtcactgctccctaggcaccgaggggcctcggccattcacaactggatccgcgggaacgacaaggtgccgggagcctggacagaggcctgtgaacagaaactgacatttttcaactcaacgctgaacacttcaggcctggtgcccgagggagacgctttgcccatcccaggagcccatcggccaggggtggtcaccaaagcaggactcatcctctttgggaatgatgacaaaatgctgctggtgaagaatattcagctggaggatggcaaaatgatcctggcctcgaacttctttaagggggcagccagcagtgtccttgagctgacagaggcagagctggttactgcggaggctgtgcggagtgtttggcagcggatcctccccaaagtcctggaggttgaagactccactgatttcttcaagtcaggggccgcgtctgtggacgttgtgaggctggtggaggaagtgaaggagctgtgtgatggcctggagttagaaaatgaagatgtgtacatggcatccacctttggggacttcatccagctgttagtgaggaagctgcgaggggacgatgaggagggcgagtgcagcattgactacgtggaaatggcagtgaacaagcgcactgtccgcatgccccaccagctcttcattgggggggagttcgtggatgccgagggcgccaagacctctgagaccatcaatcccaccgatggaagtgtcatctgccaggtatccctggcccaagtcaccgacgtcgacaaggcagtggccgcagccaaggatgcctttgagaatggacggtgggggaagatcagtgcgcgggaccggggccggctgatgtacaggttggcagatctcatggagcagcaccaggaggagctggccaccattgaggccctggatgcgggtgccgtctacacgctggccctgaagacccacgtgggcatgtccatccagaccttccgctactttgctggctggtgtgacaagatccagggctccaccatccccatcaaccaggccagacccaaccgcaacctgaccttgaccaggaaggagcctgttggggtttgtggcatcatcatcccctggaactatcccctgatgatgctgtcctggaagacagctgcctgcctggctgccgggaacacagtggtgatcaagcctgctcaggtgaccccactcacagccttgaagtttgcagagctgacattaaaggccggcattcccaaaggtgtggttaacgtcctcccaggatctggctccctggtcggccagagactctcagaccatcctgatgtgaggaaaatcgggttcacaggctccacagaggtgggcaagcacatcatgaaaagctgtgccataagtaacgtgaagaaggtgtccctggaactgggcgggaagtcacccctcatcatctttgctgactgtgacctcaacaaggctgtgcagatggggatgagttctgttttcttcaacaaaggagagaattgcattgcagcaggccgactctttgtggaggactccattcatgatgagttcgtgcggagagtggtagaagaggtgcggaagatgaaggtgggcaacccgctggacagggacaccgaccacgggccgcagaatcaccatgcccaccttgtgaagctgatggagtactgccagcatggcgtgaaggaaggggccacactggtctgcggcgggaatcaggtccctcggccaggtgcatccctgcctatccttagcttggaacacctctcatgggggactttttgcccgcaggatctctcccctgcagcagctcagaccctaccagatacaggcctccaggctccaccccacccagagctcctgaccgcacagccagcggcactggacacttccacctggatgtcccccaggcccttcaaactcaa

SEQ ID NO: 3315 - DNA, 514 bp, Artificial Sequence; identical to SEQ ID NO: 1674
  Synthetic polypeptide

SEQ ID NO: 3316 - DNA, 419 bp, Artificial Sequence
  Synthetic polypeptide
atggggaggaagctggacctgtctggtttgactgatgatgaaacagagcatgttcttcaggtggttcaaagagacttcaatcttcgcaaaaaagaagaagaacgactaaggaacatggatgaagctggaaaccatcattctcagcaaactgtcacaagatcagaaaaccaaacactgcatgttctcactcataagtgggagttgaacgaagaacacatggacacaggaaggggaacatcacacactggggcctgtcggggagtgtggggctacgggagggataacattaggagaaatacctaatgtaagtgacaggttgatgggtgcaacaaaccaccagggcacatgtatacctatgtaacaaaactgcacattctgtatgtgtaacccagaacttaaagtataataaaataaataaa

SEQ ID NO: 3317 - DNA, 1092 bp, Artificial Sequence
  Synthetic polypeptide
atgctagccttgcgcgtggcgcgcggctcgtggggggccctgcgcggcgccgcttgggctccgggaacgcggccgagtaagcgacgcgcctgctgggccctgctgccgcccgtgccctgctgcttgggctgcctggccgaacgctggaggctgcgtccggccgctcttggcttgcggctgcccgggatcggccagcggaaccactgttcgggcgcggggaaggcggctcccaggccagcggccggagcgggcgccgctgccgaagccccgggcggccagtggggcccggcgagcacccccagcctgtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3318 - DNA, 795 bp, Artificial Sequence
  Synthetic polypeptide
atgccacagtatgaaaacccatggacaatcccgaatatgttgtcaatgacgagaattggcttggccccagttctgggctatttgattattgaagaagattttaatattgcactaggagtttttgctttagctggactaacagatttgttggatggatttattgctcgaaactgggccaatcaaagatcagctttgggaagtgctcttgatccacttgctgataaaatacttatcagtatcttatatgttagcttgacctatgcagatcttattccagttccacttacttacatgatcatttcgagagatgtaatgttgattgctgctgttttttatgtcagataccgaactcttccaacaccacgaacacttgccaagtatttcaatccttgctatgccactgctaggttaaaaccaacattcatcagcaaggtgaatacagcagtccagttaatcttggtggcagcttctttggcagctccagttttcaactatgctgacagcatttatcttcagatactatggaaatgtgaacagagagagaatgccgtgagatgatggagggatagattggaatgatgtctgcgagctaaggaatactgaggattgctgccaaccatccgaagctgggagaggagatggaacaactccctcggagcctccaagaggaaccaaccccactgatgctttgatttgggatttccggcctgaactgtaggaaaataaatttctgttcttttaagccatttttaccagtttgtggtaacttgttacagcagctgcaggaaattaata

SEQ ID NO: 3319 - DNA, 1382 bp, Artificial Sequence; identical to SEQ ID NO: 1251
  Synthetic polypeptide

SEQ ID NO: 3320 - DNA, 5235 bp, Artificial Sequence
  Synthetic polypeptide
atgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggttgagcatcccaaatctgaaaatccaaaatctgaaatgcttcaaaatttgaaactttttgagtaccaacatgacaccacaaatgaaaaattccacacataagtacttaacacaaactttgtttcatgtaaaacattgtttaaaacattgtataaaattacctttaggggatgtatataaggtatacatgaaacataaatgaattttgtatttagacatggtcccatccccaagatatcttattgtatgtatatgcaaatattccaaaatctgaaaaaaatctgaaatctgaaacacttctggttccaagcattttggataaggattactcaac

SEQ ID NO: 3321 - DNA, 2564 bp, Artificial Sequence
  Synthetic polypeptide
cagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaagagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3322 - DNA, 3077 bp, Artificial Sequence
  Synthetic polypeptide
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3323 - DNA, 3038 bp, Artificial Sequence
  Synthetic polypeptide
atgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctcccccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggggacatttggcaacgtctggagacattttgggttgtcacaactggaaggatgtactcacatccagtgggtggaggccaggaatgctgctaagcaccctgcaatgcacagcagcccccatgacaaagaactgtccagaccaaaatgtcaatagtgccgaggttgagaaattccg

SEQ ID NO: 3324 - DNA, 748 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3325 - DNA, 751 bp, Artificial Sequence
  Synthetic polypeptide
atgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagcagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgggacatggatgaagctggaaaccaccattctcagcaaactatcgcaaggacaaaaaaccaaacaccgcatgttctcactcataggtgggagttgaacaatgagaacacatggacacaggaaggggaacatcacacaccggggactgttgtggggtggggggaggggggagggata

SEQ ID NO: 3326 - DNA, 472 bp, Artificial Sequence
  Synthetic polypeptide
atgtccctcctcagaaacaggctccaggccctgcctgccctgtgcctctgcgtgctggtcctggcctgcattggggcatgccagccagaggcccaggaaggaaccctgagccccccaccaaagctaaagatgagtcgctggagcctggtgaggggcaggatgaaggagctgctggagacagtggtgaacaggaccagagacgggtggcaatggttctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggcccccagcccctcctccctctaacc

SEQ ID NO: 3327 - DNA, 241 bp, Artificial Sequence
  Synthetic polypeptide
atgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcaggcccccagcccctcctccctctaacc

SEQ ID NO: 3328 - DNA, 1166 bp, Artificial Sequence
  Synthetic polypeptide
atgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagacctagcaccctccctggcacatagcaggtactccacactagctgactgagtgaat

SEQ ID NO: 3329 - DNA, 1695 bp, Artificial Sequence
  Synthetic polypeptide
atgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaatcccagctactcaggaggctgaggcaggagaatggcttgaacacgggaggcagaggttgcagtgagctgagatcatgccactgcactccagcctgggcgacagagcaagactccatctcaaaagaaaaaaaaaa

SEQ ID NO: 3330 - DNA, 159 bp, Artificial Sequence
  Synthetic polypeptide
atggcgctgtcctgggttcttacagtcctgagcctcctacctctgctggaagcccagatcccattgtgtgccaacctagtaccggtgcccatcaccaacgccaccctggaccggggagagatctgcctgagtctcctcccagctgacagtcaaagattc

SEQ ID NO: 3331 - DNA, 1111 bp, Artificial Sequence; identical to SEQ ID NO: 1156
  Synthetic polypeptide

SEQ ID NO: 3332 - DNA, 1138 bp, Artificial Sequence; identical to SEQ ID NO: 1157
  Synthetic polypeptide

SEQ ID NO: 3333 - DNA, 1345 bp, Artificial Sequence; identical to SEQ ID NO: 1158
  Synthetic polypeptide

SEQ ID NO: 3334 - DNA, 1249 bp, Artificial Sequence; identical to SEQ ID NO: 1159
  Synthetic polypeptide

SEQ ID NO: 3335 - DNA, 397 bp, Artificial Sequence
  Synthetic polypeptide
atggctacgggaacgcgctatgccgggaaggtggtggtcgtgaccgggggcgggcgcggcatcggagctgggatcgtgcgcgccttcgtgaacagcggggcccgagtggttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaaggcctgctcctgtctcagaaccttggcac

SEQ ID NO: 3336 - DNA, 289 bp, Artificial Sequence
  Synthetic polypeptide
gttatctgcgacaaggatgagtctgggggccgggccctggagcaggagctccctggagctgtctttatcctctgtgatgtgactcaggaagatgatgtgaagaccctggtttctgagaccatccgccgatttggccgcctggattgtgttgtcaacaacgctggccaccacccacccccacagaggcctgaggagacctctgcccagggattccgccagctgctggagctgaacctactggggacgtacaccttgaccaaggcctgctcctgtctcagaaccttggcac

SEQ ID NO: 3337 - DNA, 350 bp, Artificial Sequence
  Synthetic polypeptide
atgatctccatcaccgaatggcagaatgcataacctgaagctagtcgtgaggaaacatccgacaaacccaaatggagggatggctacagaataagtggcctgaatcttcaaaagtgtcaaggtcatgccaaggaaagaccaaggagctgttccagacagaagagtttaaagagacatgatcattaaataccacacagaatgatgaactggattattttgctataaatgatgctactggagtaactgatgaaacttaaatggagtctgagggttggaggatagtcacatatcaatgttagtgtcccaattttgatggctgtatgttggctgtttaggagaattttttgttt

SEQ ID NO: 3338 - DNA, 1372 bp, Artificial Sequence; identical to SEQ ID NO: 1756
  Synthetic polypeptide

SEQ ID NO: 3339 - DNA, 169 bp, Artificial Sequence
  Synthetic polypeptide
atggcgatggatgtcacaaggagccaggcccagacagccttgactctgccagactctcctctgaactcgggcctcacatggccaactgctacttggaacaaatcgccccttggctggcagatgtgttaacatgcccagaccaagatcccaactcccacaacccaactcc

SEQ ID NO: 3340 - DNA, 1606 bp, Artificial Sequence; identical to SEQ ID NO: 327
  Synthetic polypeptide

SEQ ID NO: 3341 - DNA, 175 bp, Artificial Sequence; identical to SEQ ID NO: 329
  Synthetic polypeptide

SEQ ID NO: 3342 - DNA, 103 bp, Artificial Sequence; identical to SEQ ID NO: 173
  Synthetic polypeptide

SEQ ID NO: 3343 - DNA, 775 bp, Artificial Sequence; identical to SEQ ID NO: 215
  Synthetic polypeptide

SEQ ID NO: 3344 - DNA, 461 bp, Artificial Sequence
  Synthetic polypeptide
atggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccaggtctttgttcttgcaccaccttcccagggacgctctccttgcagcgactgaaaagtgcaacctcaccccaccctccatgccggcactcccctccctcggtggcattttatttttctctgtggccccttcctatcttgtgacacataatatatcctacttatttgtccctttcttgatttgtctcacctactgagctttgagttccacaggggtcggggtttttgtctgatttgttcattgcagtggtgatttgttcactgcctaaaatagagcctggcaggtacaaagtgtttggtaaata

SEQ ID NO: 3345 - DNA, 1834 bp, Artificial Sequence; identical to SEQ ID NO: 133
  Synthetic polypeptide

SEQ ID NO: 3346 - DNA, 1765 bp, Artificial Sequence; identical to SEQ ID NO: 135
  Synthetic polypeptide

SEQ ID NO: 3347 - DNA, 312 bp, Artificial Sequence; identical to SEQ ID NO: 1728
  Synthetic polypeptide

SEQ ID NO: 3348 - DNA, 980 bp, Artificial Sequence; identical to SEQ ID NO: 139
  Synthetic polypeptide

SEQ ID NO: 3349 - DNA, 1256 bp, Artificial Sequence; identical to SEQ ID NO: 140
  Synthetic polypeptide

SEQ ID NO: 3350 - DNA, 1277 bp, Artificial Sequence; identical to SEQ ID NO: 142
  Synthetic polypeptide

SEQ ID NO: 3351 - DNA, 1358 bp, Artificial Sequence
  Synthetic polypeptide
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtggaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcata

SEQ ID NO: 3352 - DNA, 1166 bp, Artificial Sequence
  Synthetic polypeptide
atgagacttctagcaaagattatttgccttatgttatgggctatttgtgtagcagaagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagaaaaggccctgtggacatcctggagatactccttttggtacttttacccttacaggaggaaatgtgtttgaatatggtgtaaaagctgtgtatacatgtaatgaggggtatcaattgctaggtgagattaattaccgtgaatgtgacacagatggatggaccaatgatattcctatatgtgaagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtaccttgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcatttctcctttaggttctgcata

(The sequence listing continues in the following parts.)

The invention claimed is:

1. A method of treating cancer, inhibiting cancer cell proliferation or providing cancer vaccination therapy in a subject, the method comprising administering to the subject in need thereof a composition comprising a tumor neoantigenic peptide comprising at least 8 amino acids, or a nucleic acid encoding the tumor neoantigenic peptide, wherein the neoantigenic peptide is encoded by a part of an open reading frame (ORF) from a fusion transcript comprising a transposable element (TE) sequence and an exonic sequence, and wherein the ORF overlaps the junction between the TE and the exonic sequence, is pure TE or is non-canonical.

2. The method of claim 1 comprising administering at least one further therapeutic agent.

3. The method of claim 2 wherein said at least one further therapeutic agent is a chemotherapeutic agent, or an immunotherapeutic agent, optionally a checkpoint inhibitor.

4. The method of claim 1 wherein the subject is suffering from NSCLC or is at risk of suffering from NSCLC.

5. A method according to claim 1, wherein said tumor neoantigenic peptide is 8 to 11 amino acids long, and binds to at least one MHC class 1 molecule of said subject, or wherein said tumor neoantigenic peptide is from 13 to 25 amino acids long, and binds to at least one MHC class II molecule of said subject.

6. A method according to claim 1, wherein said neoantigenic peptide is expressed at higher levels in tumor cells compared to normal healthy cells;

is expressed in at least 1% of subjects from a population of subjects suffering from cancer; and/or binds MHC class I or class II with a Kd binding affinity of less than about $10^{-5}$ M.

* * * * *